United States Patent 8,153,369 (ASSESSMENT OF RISK FOR COLORECTAL CANCER) - sequence listing, part 3

SEQ ID NO: 1774 - DNA, 173130 bp, Homo sapiens
  ARHGAP18 gene - 129939934 - 130073063 of chr6; NCBI Entrez Gene ID: 93663; Build 35; sequence includes 20,000 bases upstream of initiation codon and 20,000 bases downstream of termination codon of the gene
aggtataagcagggaagaactctgtaaactccatttttgagtcttaaggttttttgtttgtttgtttttgagatggagtcttgctctgtcaccaggctggagtgcagtggcgcaatctcggctcactgcaacctccgcctcctgtgtttaagcgattctcctgcctgagcctttcaagtagctgggattacaagcacgcaccaccaggcccagctaatttttgtatttttagtagagacggggtttcaccatgttagtcaggatggtctcgatcgatctcttgacctcgtgatccgcctgactcggcctcccaaagtgttgggattacaggcgtgagccactgcgcccggccagtttttaatctataaagtgaggataatgtcattttcctctctttttgcaaggattaaaatagatgataaatgaaaagcacttagtatggtgcgtggcacacagtaagcaatcataataaatgataccatttggataacttatattattatcaaagaatcactgaagatggaagggagctgagagctcatatggtctaatcagccctttcattgtttaggacatggagacagagaaaagttaacttgcacagagctaattagtatccatatcagttctggaacccaaaattcctgaagctgctggtctttttcacactgctacccctgaattattagttctggctggaggtggatggtatgaaggcatggctgtcagggactagagtgaccctctttttatggacggtaggcaaggcagtgggaagaccacgtactatgatgactgcatttagatgaggtgtcgtgactgatccgctgtcacatgatatatgctgctgacatcctttgagataaagtcaactctaaacagtaaagataaactcctaatactagcttccttttccaaagccaagtctctactaggctgcctctgtcttaacgggaagaccatacacattagccgttgtacttcatgaagttcagcatcatgtgatgatcaggaatgactaatcatcagcaccactgtgcgattttcagggtaaaaaaaagttactagcattcacttgctaaagctgctaccctgtagctttctttctttctttttttttttttttttttttttgagatggagtctcgctctgtcgcccaggctggagtgcagtggtgcgatctcggctcactgcaagctctgcctcccgggttcacgccgttctcctgcctcagcctcctaagtagctgggactacaggcgcccgccaccatgtctggctaattttttttgtatttttagtagagacgagatttcaccatgttagccaggatggtctccatctcctcacctcgtgatctgcccgcctcggcctcccaaagtgctgggattacaggcgtgagccgctgtgcctagccccctgtagctttctcaatgatttgcaatttcctatagaaggccgctcaaggagtaggaggccaggggagcaaacatttttcccccatttgttttgctgcttagtactcttgactgtccagtatctccagaggtcaggagttttgggacactgttctttgaatcagttggcgactgtcatcatcatacctatatgacctgcccatgtacaaagtgtggtccatcacactgccagtgaaatttgcgccatagatatataccatagacccatcatgtgggagcttaaaggtgtgcgggggtccccaggagcagcacaacccctcattttacaaatcagaaaattcagcgcgatgtcactggcccatcacatcttgaaggaccacagtggtttttgcctttctttttttatgccagtagttacacctggtaaagataatacttcggttgtcccagttctagttgaaaatgttcaacacccaacagaaacatagttggtggtagttcaaagctacaagcaaaaggcttatgttctccatgcacgtgtgtatattctgggacaaattagtcccttcctttctgggatttcttttcccatttcagggatctccttgactcgcgtctttgttacattgataagggcttgaatttaccacatttcctgggaccagtaccttgggggagcgattaaaataaaatctgaggcccaaggggatatttcaagtataaggagaagagagatttgggtgggtggcatataattgccttctcagagatgctcaactcataccaaatagatggctgctctgacccctagaaacctgaagaaaagatcctgattacaggtctgtttctagaccagatacatgcagcaagaatgtacaagggatgtttccggccctggaataatttcaaggagctaagttaataatgtctccagtgtctaggatttataaagcaaagatcttctaaaattagatacttgtaatttataattaggctaaattatggttgttgattagtgattaaagtagtggtttaatgctgtgctgtagagaatcaaggacttcatattcttctcttggtgcaattttatcatgtattctgaagctcaataagataaagacaggttgtgactattgagaaatcagtcattgctaatctgacagtggttctggtttctttaggagaggggaggtaaaagcatagagtgaaaatgattatttttccttgcaatttcagaatttatagttgatgttacttttccttcacaggtgatatagggttgtattaataactgattcagtgcaacagcttattcttaccacagacttccagcatttattaaccagataactattctagcaaggatttaaagctaccttatttcttgattttgctgttctcaggattgacactgacccatccacctcctttgtggggatgcagagctctcgaggcatttactcgtgtccttgggcagatcagtggcttttactttggcacttcggcatatttgctcaacaaatgctaatgaatgactgtgtgccagatggcatattgagagtagggaaatggatggaacttcctgccctcaggaaacagaatcctatggagtctgtgtgcatatgtgtatgtgtgtgcacagcagaggaaagggggttatcggaagtataaataacttcagtatagcacaatagtagaataaagagtgagacacattccatgtcaacatgttataggtgtcataccttgaagtgtttttcatacttcaggtaattgggcctttctagagagtgtctaagggagatctaaattaataaccagttctttcccatgagaaatgaaggctgtcacttttttaaaatgttaggctattgtatgtgttttagcagtgcatgtttaactaaaaatagctaaaagaacagcctcatacccctcttatggtgagacagagtacagagagtactctgaaagtaagcaagctggcaagtgctttgctacttagtggactccagtccagggggatttagttattgggaccaaatgttatttcaacttaagagtgggtcacctttggaacaatcctttgttatggacctggaattcattataatgaattccaatgaatctatggacacttatatgaatacaatatagatccatgatatttccttggtcaaacgtaaacaaacaaaggtgtcttgtttgttagttgaaagactagcatttgaaatactgtagctctagctgctaagttgttctctaaggtttcattaatgacaaccaacacaacacaaatctgcctgagcctggaacgtctaactataccataatacccctttttgaacagatgtcatgagcagcatgttttagtaaaaagtcagatgattgatttagagtcaagagacctgggttcaaatctaagcactgttggctttatctctggcaaattgtttaatctctctgactaatctttcagtttcctcatttgtcaaacagaggcaatggggtagaaactatttcagaaaacagaaatgaaaaatagtacagaatagcatataattgacattttaataaatgcatattgttttcagctcaaggatttaaaaatctgagcccactagctttttgcaagttcattattccatcttattcatcaatatattaccatcactgtgagtatcacagtgcctttcactagtaggtacatgccaaaagtatttgctgaatgaataaactgcgtagacaaggaacacattctcatagaacaataaacaaatgaattggcaatatttatgccatgggtgatattttagagctaatttggcaaccctcatgttaatccaggaaatagagagttaagagacaatccacaactatcaaaagatagttagggattttcttcttttattaattaacttgaagtgtgctgaatcaattaacgtgacaagtaagtggctttgatattcggaaatgaatgactgtgtttctaacacatgtctttcaggctacaataaattcattgattggtgcaaaacagaaacttaaaggatgtaaactgagtcattgccaagtgatccagggcatagcaggtggtctctggggtttgtttaggtcttcaggtgtactcctagaagacagaaactcatcccagcaggactgtttcagtgaaaatgctaaggtgcaggtcagccaagggacaatcccagagtctttccaggagcccaaaaaccaagccaaggaacgtgacgggtacaggtggtgatgtgcaaagtctggaggaatccaggcctgggcaggttccaataacccatgtcccattacaaagacttctgtgccagtcggaaaggtgacaaaccttcctaaaggtgacaaaggataaacagatgaatccagggtaggggctttcataataaaattgatgctttgcatttgacgtcagttacttgtgtgtaacaaagatgatgaggtggtaagtgactgcctgcaactaacttgacctttgtgtttgccatgaaaaaattgacagcttgttctgtccctgggataaataactactccatgctttgtgtaccctcttatctttgcagtcttctatcgtcatatccagagctattttttggtatatctgctgtccttgaaggttgagacaatgctacacacagagtaggtatacaatgttgactgaataaatggctctatctctatcctttattaaagatttgaaagacctggtaagccttaaaagaaccaagtttgtaactttatgaaatttaaaaattggttctacttgggcactctgtttctgtctcccattgattctaagattatatttgtttcattcacatttaaacttctctgaaattgcagtgcaaccttacagttggttcataatattattggcagtggttttttttttttttctttacaagctgttggcaaaataatgaatggtgggtctaacaagtgattgatttcttagatttggtaaactaataataacaaaactaagctcatcttatatggtgctttatatataggaaagaataatgggaaaagcatgaatttttgaatcaaagagattttattctgaatcctagctctgctttttttctttttttaatctaagcaatttgagcaaagagcttgtcctgctgttaatctttgagttgcactgttctcgtctatatgatgggaataaagcattccatattaggcttcggcactatgcagacattcaatgaacaaaattcaatgaaagcctgttcttctgtaccccctcaacaagcttatttgtaccttagaacagccctggtaggtaggaacatgcatttccattttatggattcagaaacagaagtttagtggcatgagtgagttaagagagagacctcctcagagcctttgttttttccaatatttcctagagttccattaggcctctcacaggtatctattgacataggtgagagcttagctactcttatgttgaataaatctccttgggcagccaatgtagcagttttacagaataacttaataaacaatgtcatacactacatcctttttggaaaggattttacctcttgccctcatcctgtaaacaaggatgggcctctatttaaagaagaggaaaaggaagaggggggaaggatattattcacctggcctagcattttttgagcagatgttttcctcctttcattgttcacagaaaattggtttgaggtcatataaagcaaatgttcaaaaaaactgtgatccataaatcaattcatactattcttttgcttggatagagcaaaactatgaggatggattgaaaattaaagatcaatactaaaacctcagaccatagtgtcaacccaaaagcaaagcaagttatcagtattatattgttatagagcaatagacagtacgtattagaccttcaggccttaaacatccagggtggaatcactggtaatttcctgtggaaattgcttttatattttcatggtctacctggaaaatcttcaattatgaccttttttagctttagcattttttttctgtttagtaatcacattttatttaggttgcaaatggatcaagtaacaaagaaataaacttatttcagtaatatcaaatgtccaggccaggcacggtggctcacgcctgtaatcccagcactttgggaggccgaggcgggcggatcacgaggtcaggagttcgagaccagcctgactaacgtagtgaaaccctgtctctactaaaaatacaaaacttagccgggcatggtggcacatgtctgtaatcccagctattcaggaggctgaggtaggagaatcgcttgaacccaggaggcagagattgcagtgagctgagattgtgccactgcactgcagcctgggtgacagagtgagactccgtctcagaaaaaaaaaaaaaaaaacaaaaaaaaagtcctcaaacctaaatgaagatgatatggatgcctgttcctggaagttgcagttagacttccaagtgagcctggcctccttccagcctctaccaaaggctggctataccatcttgggcaaccaagtcactgacacaccttgaagtatcatcatccctctgttgtcaaatgggggattaagagagaaaaaatatcttaaagagctcagcgagtgtctaaaacttgatgcttagtaagttcacctttctgatctatcttctccaccctcctttgctctgcccttaaaccctgtatccttaatgaaaaacttccctgaagttttgaagtttaaagcacctatgtgggctcccagtgtagaaattaagcatccctgggaaatgggtaaatgcagcactcgtgaataaggcagacacagaaaaaatcctttggacaactagttctcttggggaaggctgcctagagatcaaaaacctcaattatgggccaggagcagtggctcacacctataattccagcactttaggaggccgaggcgggcaggtcacgaggtcaggagatcaagaccatcctggctaacacagtgaaacccatctctactgaaaataaaataaaaaaataaaaaaaataaaaaaaacattagccaggcgcggtggcaggcgcctgtagtcccagctactggggaggctgaggcaggagaatggtgtgaacccaggaggcggagcttgcattgagccaagatcgcaccactgcactccatcctgggcgacagagtgagactccatctcaaaaaataaaaataaaaaataaataaatggaacctcaattatgaaaagagagttttcaacactgtttcctcacctactgacttctgccacacacttcaaaactgtatgcccgaggccttcctattgtgggggactatcagagtctgtcttctaaccatttgttagacatctccattcatctagcgtaaaatccataggatagttttggattccctctttcattcccacttccacatatctatgaggttctgaagattctattgctgcagtgtgtctttgcattggccctgctgtgtgtagcacgtgctgggggagatgatgaagcagagatggatctgcccctgttgtcctatcattgcagcctccttactgatatgctcaccgtggcaacctcctagccatcttttcctcctgttcctggctatttattcacagccaccactgtgttttctctttgtgtagatctgattatgttgctatctctctcggttaccttggattattccccactgctatggaatatagatgaaatacttgcaaagcactggatgtcccttaacatctggtagaaatttatctatttctatggcggatctccctatcctgcctccccttccccatcctgcatgcttcacagcactttgtgaacataccttgacctagtgtcagcagtcagccttggcttcttttgttccccctccttatgaacagccctgctctacccaccctaattcaagatatagtacgttagtacctgatgtatgtttactagcattttctctagttataataagtgttgaatacagaaaacttacgggaaaatcacatatgcccactactttaattgttaaactttaatagattttggaaatatttacaactaaaggtccacttagcaatagagtatacttatttttgcatttatgatttaatgcttgatgtcataaataggcacacatgtgtccatcctaactgaatataaacacctgggggcccgattgttgtatctgattcatctattcttcttacaactatttgattgaagtgaatcagtgactctgcaatataaccccatatgtgactttgatggtggaactgcagattgatagggaattattttattggaggcaggtctacttgtccccctcaaaacaccggaggagaccattgctggtgcctggtacctgctcttggatgagctgaggagtctcagacaggatcattttgtgcttcttgttcacactgagatggtagaatttctgctctggactgaaacctttgaacaagtctcttttttaaatgtttgatggtgactctactgaatttcttttttatatgcctctaatacatgaatgctcccaatagactgcataaaatactgtaaaggcagtctatcttgaaagaaatgaaatcatgaaggcctctgcctatttcactttgttttctccaactgatgtattcatttgcccactacagttttattttgatgatctttgtaaggttaagacaagtattacttttgagcctggcagacatagtaaggagaattctgatatatgtctcatttttgtgaccccaaatgtggctctactgccttgatttgaatgcttgataatttatagtgatataaatttcccagaacatcacagagtatgatttaatctcaaacacttggaaggttatagtcaccttctggaaaaaatattaaaactacttcaatgatctacctttgtcacaccaaggcactctctccctgcttttcttcactctcatgccaattgtgattaaagctttttttttttgatgaatatatctaatctgcagtgtttagaggtattctctctatgtataaaatgtattgtgatgtccttagaaggatgatggctagacagaattttattatgtttattgttattaatccttacttgtaggaatatgacatatctgtattaaaaatgtagttttattgaaaaaggaagctgggcgcggtggctcacgcctgtaatcccagcactttgggaggccgaggtgggcggatcacgaggtcaggagatcgagaccatcctggctaacatagtgaaaccccgtctctactaaaaatacaaaaaaaaattagccggacgcggtggcgggcgcctgtattcccagctactcgggaggctgaggcaggagaatggcgtgaacccgggaggcggagcttgcagtgagccgagatcgcgccactgcactctagcctgggtgacagagcaagactccatctcaaaaaaaaaaaaaaaaaaaaaaaaatgtatcttatagacttttaaagaaaaataccaaaaatgaaacatagttactgggaagacgggttgatggaaaataatatattttttactctctgtagtggaatttgatttttttcactgtttgaagtatagacagtcttctgagtttttggtgtggttttttttttttttttggtggtgtgtggggcggggtggaatagaaattttgaagacgttatttatgagtgattcttaaggctttggcatcagttcttataatagttattttgatagagccagggactgggtgttgaggcagtctctgaactggagcaatttacactgtaagaaagcgttttggtttcagggtatggagttttcctcaaatcttacagtcttggctctgtaaccatttgcctgaccagctgttgcctaacctttgtttccttagcagctgtttctatgaaaaaagatatttggactacatataaactctggacaacctcagccctgtaattttaagtctctgttttaaaatttcagaaggccaaggtccttgtgattatagctgtgttctttgagccattgtaacgaaccagctagccaaattattaaatagaattagggaaaataacctttccagctatttgcagagcatatttcaggagtacaaaccattttggtgctaggatattatataaagagatctttctcaattagagtaaggtatggggcatttgggtgaaaagcctttacagtaatatctacacagtgattgtcaatcttttctgaaggcacggaatcagttgaaaattacggatctttgctccaaaaaaacatatcatgaacgatactcaaaattttggatgtgatttacttattttactagaaatttatttttgcataaagaatatataaccaatgaagcaaatactttatacccaatgaggtaggtaagtaaattacaccaaaacttgccagagacagagtacattatttcttcattttagctttctattaattgtaagatgagtcaagtcaattgatttttgggaaataagtcttgccaccgtatcaaataatctgaatgattttaaggtatatactaattttgaatatgttaaaatctgtttcttaaaattgaggggatacagtacaaaatttgtttacctatagctcacttatatgaaaaaaaataatggttatttctggaaacaaaaatccccaatggtcataatggtcatataagagacaaggtaaattcttccccaaataaattttaataagattctatttttccacaaaataatgtgtgaatatatatacacacttatatgcatatatacacacatatatacatatatatatatacacacacacacacacacatatatatatatatacacacacatattagttttagtttttgagacaagatcttgctctctcacccaggctggaatgcagtggcttgatcatggctcactgcagcttgaccccctgggctcaagggatcttttctcctcagcctcctgaatagctgggactacaggtgcacgccacgttgcctagctaacgttacatatatatataattataatataatatatatgtaatatatatatatatatttttttttttgtagagacaaggtcttgctatgttgtccaggctggtctcaaactcctgagctcaaaaaatatatatatataatatatataatatataatatatataatatataatatatataatatataatatgtattttatatattatatataatatataatatgtattttatatattatatatgatatataagatgtattttatatattatatataatatataatatgtattttatatattatatataatatataatatgtattttatatatatataatatataatatgtattttatatattatatataatatataatatgtattttatatgttatatataatatataatatgtattttatatattatatataatatataatatgtattttatatattatatataatatataatatgtattttatatattacatataatatagaatatgtattttatatattacatataatatataatatgtattttatatattacatataatatagaatatgtattttatatattacatataatatagaatatgtattttatatattacatataatatagaatatgtattttatatattatatataatatagaatatgtattttatatattatatataatatagaatatgtattttatatattatatataatatagaatatgtattttatatattatatataatatagaatatatatatttttttgtagagacaaggtcttgctatgttgtccaggctggtctcaaactcctgagctcaaacaatcctcctgccttggcctcccaaagtgctaggattacaagagtgagccactacacctgactatatattttttaaatatataatttattttgctttcattttgctaacaataattcctgaaaaccttggttcccagaggtctatatatagtagcagaggaaattagaattcatataacctgctgtgcatggttgcttctgcctgaaatactagctactcagggagactgaggcaggatcacttgatataaataaataataaataaataaggagttcaagaccagcctgagaaacgggcgagtccctgtctttaaaaaaataaaaattagatgggcgtggtggcacatgtctgcagtcccagctattcaggaggccgaagtgggaggatcacttgagtccaggagttcaaggttacaatcagctttgattgtgccactgcactccagcttggtgacaagagtgagaccctgtgtcaaaaaaaaaaaaaaagaagaatttgtgtaacttgctctgctagacacagatcaaggctgactcatctagaatcttcacaaggcccggagttgaagtcatgtcaggaagccaggaattgttactttcccatttatctgagtaaaagcaaatttgaaaaaaagttatattcagtttctggagatttttgcttgcagagacattaagaatttgtccctttctgtgccagcattcaattgtggcattaaaaaaattttggctagtatttgtttccaatctctgctgacacagtggctgcttgtgcaaaacaactctgcatgttctgaatctttaagaatgaaaatatttaatcattcaattgaccagaaaaaaattactgttaaataagccacctcccatgcccattaaattcctctttgaaattatcttgagggtgtgttttccttttctctgaaaaactaaaacttttctgtgaaatacagtcacatatatctagatatactctagaaaactaatgaagctttgtcataaaagagaatactaatatttttctattgtttcttaatactccattttaagatattagtaattaaggcccaagttctgatgatactgataacttacatggccctaaaatagttgttcttgctactaatttgtgcacttgtagagggcaatgatccatgatgatatgtgaatctcatctcttcaccagaaaagcaagtacactagtgaatatttaagatgctccatttgtaagtagggtactaggattccttttttccagaaaaactttgcttcaccatttcttcccctctactttcaagaagggaagcagaaagctttgccatttttgaggacatttctaggactgaaaattccccaatgggctcagaatatagaaattattatttaatgacatttgtgcagttttatcaagtattttgataaaaaaatataatactccagggactactttaaaacattagaagtactgccttcattttggagtggataaccaccattaataaaaaaaggccgggcgcggtggctcacgcctgtaatcccagcactttgggaggccaaggaagccggatcaactgaggtcaggagtttgagaccagcctggccaacacagcgaaaccctgtctctactaaaaatacaaaattagccaggtgtggtggcacatgcctgtagtcccagctactcgggaggctgaggcaggagcatcacttgaacctgggaggtggaggttgcagtgagctgagactgcaccactgcactccagcctgggcgacagagcgagagactccgtctcaaaaaaaaaaaaaaaaaaaaaaaaagaaacatggcttccttccatttttctttttctccaagccatgaatcaactcatccctttccttagatctgcagcttcaccattcttccccactcacagtggctgcttttacataacaaggggataagcatcatttgtaatccactgcaggacaaggatttttgtatttgacaaatctaatattgatacaattgtagacttttaaaattgaaccttatattcataaacaaaattctacttttccagtacgtattagcctccagaatatacttcatcattccagttgcaagtgtttgcaacatgtatctccattctagttgtcaatgaagagaaaaccaaaagaaaatttagggtcatggcactttttcttggataatttccagcttaggctagttttgatatgaagggcagatttctcatgaagttaaatgagattgaatcttcagagtctggctcttgcataaggcctcatccaaggctccatagctaacaaattctataagctttgggttccgcacatcgaatctgcttttttaagaaaaaaaaattcataatcatagtgatcagagtactttttttcacttctatcagtggaaacaattttagatatgatggcacaatgatgatgaccttttagactagtgtatatattatgccacactaccccaataatttgacataaaaaaacaagtttcaaagtaccagaaaagaattgagtgtaaatctccatagcattgtatttatatcaatattccatttgattaaggaccttaggtttgctgtagattatttaactttgttattcatatgattcttttcagaaataaaatgatgtcaattctaggactgctgtaacctttataatgcttaagagctcaggctccaaggtcacataaacccaggtttacatgtcctggttctgccacctactaactggatgacctcatattcctcatctctaaagtgagcgtaattccaatttctatccctggtggtgattgtgatgattaaatgatagaccatgtataccatgtctagcgaagagtaaggactcaatattagctattgttatttattggtaataaactatttgtaagaaacatcttttctaaatgattgccgaaaagcctaaattagcctctggcaatagcagttacaaattatcccaagcatggctagtattttctcgcaggaggagcagttaagaaaataactttgagaataacgtagacatttttagagctgtccagagaaagggaaaagggttatttcttgttgttccagagacagaattaataacaatgagtgtaattcccaaggaaatagtttgagattctgtatatggaataattttcagtcatagtaccctagcacagaggtagctaactttgtaagctgacaagaactattcctacgaggtcctgataaaacatgaggtaagggatgttaagaactcttcctcttcattagtcaatcctgcttcatatgtctagcctttatcacctatgtaaaactttaacttcacagttgattaatttattcaagttcttgttataatattgaaaattgggtttaattttaccatttggaaggtcattttcacatggcttttgtccctatgtagattttcatcatcatatagagattgtgtgtacatattctcctttaattctttttttttttttaagagaactagaccaattcaggaaaaatttgataaattatatgctgattccattgcatggcactcttctaatacaattccttctaatactaaataggctcctaaatcaacatataaaaaccagctaataaactctttgctaccactagcactgaactgaagaaaaattttttcattgtttttgaacatgggtgtcaaattgtcagagactgcagtaccatcttcaccctatttttaacaacctatttgggtacataaattaccgcttccttttcctttcctgtgtcatctagtacacctcatttaaacagaatgaatgaaatgaatgtttaaactgtcttgatgttgttaattactttttaagatgtttcataacaggaaagtgtttggcacgcactcaatagctgggaatattaacatcttcaaggtcatgaggttctcagtgtgtgtttaaaatggttgcggaaaggagtaaaaaagtgttttgttttttttcataatatttgtctctgcaaaagagcgataatggtataagggatggacatgagctaaaccttagtacagtttacagtgtgaaataagaacaggtttttttttttgtttttgtttttgtcgttgtttttctttttttctttttcttttttttttttttttttgagacggagtctcgctctgtctcccaggctggagtgcagtggtatgatctcggctcactgcaacctccgcctcctgggttcaagcaattctcctgtctcagcctcctgagtagctgggattacaggtgcccaccaccacgccacccggctaatttttgtattttttagtagagacggggtttcaccatgttggccaggctggtcctgagctcctgacctcaggtgatccacctaccttggcctcccaaagaacagctttttaagagaccacactggtagttaggtttgcttctttgatgacatgggaaaattctgaaaactgtttttaatctacttgagcatgtatctgaggctatgaacaccaggccacagtcctaccagctctctgcctgtgataggtaatacccttcgaccagtagcaacagggcttggtgggaggaaaggagaaaaagctcagaggattttcaggtatttgagagctaaattagaaggattcaaattttatgtactaagctatgtaaatcaatttgtatcacatttggttttctgcctcacagaaattaaaaacggtggatattgcaaacccaaatattattttgacattgtaaaacaattacatttcaacctgtacattgtgatttgttattaaacaagtgaaaagaccataattaggcaaaaatataactaaataattgttttggctataactggacaaaatcttcatcgcaaactgtcacatgagagatgcagtgcccgtggctgccaatgggcatggatgacattgacaggctaaagacatagcaaaggaagaaggaaaactagaaaaaaaaggaagataataaaaagggaggtagagggaagtaaggggggagaaaaaggtgggagggaaacagaaaagaatttccaaaagataatgtagtgattaccatcaataattgtataagatagtgattcccatatgtttgcatttcagagtagctacataaaaaaggaggggtggatgagctggttattaacattttttccatgtaaggacactgaaaagacaaaacacatatattctaatttactttaatctttgcctccctctctttatagtttttgttttgcctgaactgatgaacatttcctcataggttagcactggtatgtgcatgggaaccgcttatctaatattaccaattttaatataaagatttagtagagttggccgggcgcggtggctcatgcctgtaatcccagcactttgggaggccgaggtgggcggatcacctgagttcgggagttcaagaccagcctgaccaacatggagaaacccagtctctactaaaaatacaaaattagccagcgtcgtgacacatgcctgtaatcccagctactcgggagactgaggcaggagaatcgcttgaacctgggaggtggagattgtggtgagccgagatcatgccattgcactccagcctgggcaacaagagcgaaactctgtctcaaaaaaaaaaaaaaatttagtagagttttaaaggatactttcaattcattcaggttttcctccattcagtgtttactgaaggctcagtaggtacaaaatttaagttagctgtcagatgaagagaaaagaatcatagtaggacctgaaaagattgtgtctagcagatggaaagacttgtatgtataaggtagcaggaatgcccagtgatctgctcaaaagcctggaactggctctgttagcaatagagagccaatgaaggtttttaagcgaggagagggatcatgagtgccagggtgtgatcataatgtcaaagcaatttaaaggaggtgacagggagatgagctaaaagggctgttgtaatattggagctaagactgcattataggatccagaggtggttgaggtcatggggataaaaaggagacagcaagtaaagtcctatggaagtggaaatgggaaggttgagcagttgtgcaggggggagggaggaagatataaattccttttaaggaagacttttgtaaattataagaaagagggttcaaaaataaatttcagatacttctagagtatgtaaggaggaagaaattatttttcatgactgttttaaataatgataaggtataagcaataagtttatgtaatgatggaattggaaacttgttcaagaggaattctagagagttgaatgaatcataaaaatctaaaaaaaccttcagactactgggtatgtcagagtagaagccaggcgtggtggctcatgcctgtaatctcaatactttgggagcttgagccaagaggattgcttgagcccaggagttcaagaccagcctgggcaacacagtgagaccctccctctccacaaagcataaaaaaattagctgggcgtggtagtgcatgcctgtggtcttagctattggggaggctgaggctggaggatttcttgagcctgggaggttgaggctgcagtgagttacaatcaccactgtactccagcctgggtgacagagtgagaccctgattcaaaaacaaaccaaaaaagtgatttttttttttggaggggagatggggagaaagaacagagctgtcttttgtgtttatgataattttgatcttgtttcttaatctgcaaaacaaagaagagcatactggtgaaaaataaaaggaatgtagcctagaattctgttcaaatccagcttctggcactagcaactgtgttatcttagtgaagttacttaactcgtccctcagccttactttccttgtgttatgtataacacagatgatagtgatacctatcttgtacggtgtgtgtgtgtgtgtgagagagagagaattgaatggaatgagataatacatgtgaaacccccgtccatgagagcttggcatatagtaggtgctcaacaaatggcagggacttctcttgttctcagcaataacacttaacagagcattggtaggtctatccctttttggtgctgaaaaatattttgctaaaacaagacgtatatttgagattggctttatgtgaaagacgacgacattccaggacacacaatttttatgagggcatttttaaccggacacaaggatcaagcctttctcgtcgtctggattgcagagttttgccgcgggttcgttgttttttactatggctaattttaacgctgaacatgaaggggttaagaaatgcctttactcatgttacattaagtagcagaaattataagatagaggaattggggagggaaaaaaaaaagccttggcagcaactcatggtttcctaagtaagacggcttgtagttacagtgatgagttgaatatacgttctggcagtttaatctgatcagactaacttgggggtgggtgcaacccgtcgcttccacccttcgcctcctttaaccaaagccgcccagagtgcaattgtccagagttgaaaccatgctgtgagttgcagcttctaattggagaggcaggaagcccttccctggacagaccccgcccctccccgtgtgaatcgccagcctgcggggaggagctggccaatgctaatgagcgagttgccaggcgagacaggaacttctttccccttctctgtgtcaggatcgcagaaagtatgtcccttctctcaccatgagctggctctccagttcccagggagtggtactaacagcctaccaccccagcggcaaggaccagaccgtcgggaacagccatgcaaaggcaggggaggaagccacctcgaggtaagccttcggaagctgaaaacaaaacaaaaccctcttacctgctccaggaagaaagtgacagggaagttggcgtggggagaagggaattccatctgcacgtcgagcctgagctcgtgcagcagcagtagcaacgtttggcgtgatttttatgtacttttcatctcacctagtccaagtctgaaataacccatatgattactggtgaagacagagaagaaggaactggggagagggctatatgggctgtcagactagctatttagcaggtgcatttgcacatgctgaaagatcaaataggtctatctgaaacacttcctttcctatgaaatggaattcttgaatgggctcaaggcactgccactggaactgttcgctgggaaagtctgccaaaaagcagggaggctgttcactgtactgtacaagctgttgttgttagagtgttttttttcccccctctctttgctgaaagcaaacctcttaggcaaaaagcccaagacactggcctgtggcaatatgtttcacattcttttgtgtatgtggattttttttcccccaggctttcaaaaaggagtttttgtcaggagatagcactctgctgctggagtgaaatgtggttaatgttaaatcactttataggcagagagggcaaatgttctatagaccactgaggcgcaaagggtacctttctccctatctgtgtactttgttccattttccaagggcttttttttttctttctctccttaatgaccttctcactagctgaacatttttacctccatcaagatataaatagtaaatattggcctagaagattgcaagaagcaaatactaacctaatagcctagaacactaaattagttatcggtaagcacatttcctcctcaatgcttaatgtgataataaaaccttctttgttcttatgtgacttatgcctgtgccttaagctgaaataatgctgcctttcatttgttttaaaatctccaaatatgagggagggagaaaaatcaaaggaatggctgtaatactcagtgttagactcccagctgacgggaactgtttctcacatagcatccacagtatgtatttcattgaatgaattcatttccaaagataaaaaagatttggtgcttgtgccttagctgtgttaccatttcattttccatcattttaaatgacttaatgttaaatcattaaatcaagagatcttgaagtgttttcatccatttttctgtaatgtattagtaatcattaagcagtaaagcagcctgcaacaccaaccccatacccagccataacttggattccacatgtcagtcaaaattgccaaaattatacaagctcaggacattctccgactttaggctgaatggcctgaggacctgagctgaatcttggatcttgattgtgagaatggaaaggaccttaaggactgagtcctaacctctcattttcacgtaggactcaaaccccagggattagttaagtttttggaaggtctggagttctaggcctttgtctggggctgcatctccagttctggagactcattattctgtgtttgcagtgtgggtggcccatacttgagtgggttgagagaataagagaggatcagatcattctctgcctaggctgaagcagaaccaagaggcactaaggtggcagggtgggcagctgcccacacggcaagtgccctgtgtggggccacagctccaggtgagctcctttgctggctgtcacgtagcctgcccataccagacccaacttcccaccactgaattagttctagggatcgttcctgatattgaccggagaagatgggagcctggtttgagggcagggaggaaggagggagtagggctagttttcaatggcttttacccttaagggctaacgaatcagataaacttgttgttgttttgggagataccctgtttagcctgaaaggattgagatactgtaattgctatgggggaggggatggatagaaggaaggaggatttgaaggtgggatggggtcctcggtgaccacctaagaatggtgatagtggtttcggggcggtgaactggactttggctttggctttggctgggttggtcaggtgttgttttaagccctgggaagctgctccaaggtgcaaggttgatggttgatgcctatttaaagaagttctccaaaaagtaaaaacaaaacaaaactcttaaaaaggctacattaggctgggtgtgatggctcacacctgtcatctcagcactttgggaagctgaggtgggtggattgcttgagctcaggagttagagaccagcctgggcaaaaaaaagacccccgcccccacagctctaccaaaaatacaaaaaaaaaaaaaaaaacaagaaaccacaaacaaactagaaatggtagtgcatgcccgtggtcccagctactcaggaggctgaagtgtgaggatcacttgaggctggtggagcagagattgcagtgagctgagatcacgccactgcactccagcctgggtgagggagtgagaccctgtctcaaaaaataaataaataaataaaaaataaaagctaaattagattctgcatttcctcctacccatttaaaaattatagaagatagcacggaagtataacttttcttatcacaagattttgtctgtaagtaatatgttctttgaaatatttaatccaatatttagttcatgagatgaattcatgtctttataatgccatttatacatatgtgtatgacttagcgtatttattgaaaattgtttccttttttttttcgagatggagttttgttcttgttgctcaggctggagcacaatggcgcactcttggctcaccacaacctctgcctcccaggttcaagctattctcctgcctcagcctctatagtagctgggaccacaggcatgcaccaccacgcctggctaattttgtattttttttttttagtggagtcggggtttctccatgttggtcaggctggtctcgaactcccgacttcaggtgatctgcccaccttggccccccaaagtgctgggattacaggcatgagccactgcgcccagcctgaaagtgtttgatttttagcctagccataccaagtcttttttttttttttttttttttgagacagagtcttactctgtcacccaggctggaatgccgtggcacgatctgggctcactgcaacctccgtctccaggctcaagtgattctcctgcttcagcctcccaagcagctgggattacaggcgagtgccaccacccctggctaatttttgtatttttagtagagacggggtttcaccatgttgaccaggctggtctcgaactcctgacctcagatgatctgcccacctcatcctcccaaagtgccgagattacaggcatgagccactgcacccggctccatgtccttttttattaccatttggtcttttgaaaagctgagatagtagggaattaatatttttggaagtaatttgttagctaaattttctccattccattatccctctttatcagaaaacagtcattgaatgtcagattaaggaattcctcccactcctggttagagcctctccctttatagaatcctgtttttcttttgtatgtttcctcctcaaaacatgaggatttgaagaaatatgttaacattagttgtcatggccgacttgtacacagttgaatgtttccaaaggaaaccactttttatgagtagctatatttataagactttgtttacttgtttttcaagcaggcttcttaatatttagttttgaaaagaattttttcgaagaatattgtgttttgtctattcttactgttctctcttaccttcccattttaagagaaatggttgtttgctttgcatattttttgctaatattttaatatgaatgtcaagtaaccttttttattgggccttttaattccttagctaactgaatggactgatgagtgagatatttttatgccttctctgaataaatgtatggcattcatcatgtaaggtcttgttgacccaacttgccattggtattgggtaggcagaaacaagaggcactacacaggggtgacataaacccagaaaccctgggttctggggccaacctgtctggggtcatatcccagctctctcattcattagcagtgtgaccttggaggagttatctctctacccataaattgaacttcataatattactcacctgattaagacaactgagtgggatgacctctgtcaagcccatagaagagtgtctggtttgtagctagctgctactttccttaatactaggtaaagaaaaggaaagaaaggattgagttttgcaggatatagaatattctcccttgtttcagaagcgtttttctgaatattattttgtcatgtgttaagaaacatgggcattatccatatgcttaaaaaatgacatatttgagaatgaaccataatgtaaaagtttaggcctttgaagtttgaaagaccttggaaatatcatcctgatccatagcaccatttatgatttgaactggtaacaattgcctataccaggcctttcttggggggtattgatgggcattgaggtctgcaaatattgactctatggcaagatagaatgtgggtggatcctcttttggcagctggactcactcctgtctccatgcttccttcctctgctttaagaactactactgcccagcatgccaaatggaagaggactatcatctttataagcttatctcagttcttgacttgttcatgtctcacccattccttggttctgcaagcataatcattcagtcattccacatataagagctctctcttactgtgtgtcaggcaattgtttaaatactggggttgtaatggggggaaataaaccagacaaacatctgggtgcagggagggtagcctggaggggaaaataaagacctgagcaggtgacaggtgagccccaaaatatctgggggcaagaattagaagaagagtttttaaggcagatagtgggtagagagtgtagaagccataagcctagatagagtaagtctgaaaccaagcacccagagagcaaagagccctgcatgactgcaggggtcaggataaggaggagggaggaagaagaaagcaaggtgggagttgataaccttatagaacatttgaggacttgagtttttgctgaaagtaagatgggaagccattgagggagtgggttttgagcagtggaggaagagagcacatttaaaaggtccctctggctgttatattgattatagagtgtagaagcagtggtactgcttaataggttaaggcagtggtggtttgggccagggtttcagttgttttagtaatgaacggggtgagcagtggaatcttttgacattagggcctgtaggagatggacaaatgagaatacctgaagattcaaggtttttgccctaagaaacttgtaatgttaaagtgatcattaatttagatagggaggacttgcagaggggcataagggggctggggtaagttgagcgagacatgaagctcagtttttttttgtttgttttttgttttcagatactgagtctcgctgtgtcacccaggttggagtgcagtggggtcatcttggcacactgcagcctccacctcccaggttcaagcgattctcatgcctcaggctccccagtagctgggattacaggtgcctgctaccatgcctggctaatttttgtatatttagtgaagatggggtttcaccatgttggccaggctggtcttgaactcctgacctcaagtgatccgcctgcctcgccctcccagagtgctaggattataggtgtgagccctcacgcctggcctgaagctcagttttgagaaatatctttttgagataaacattaaagtaagaacatggctggctgtcttgattagttcagtgtttttacatgaatcttcacaggattttaaaaacctatgtagtataccatttaaaaagtttcttcattctgaattagtgtattattacctgatcatatatatatatttttttgttgttgaaaaaaagggatggtaatgagtttttataatgcaattgtgtaatatttaaattttattttttctaaccttagcttctaaagcgtatttcctcattctaatttcatagaatttagtgactaaatggatttaaacctgtccatggggataattgttttccagatcaatctcttcttcaatttcatgacataagagtcctttgtaaaggcattttcttcactgtggtttaaaaaccctatccatagtttcttcttgaattattagaggttgcacccggtgtccaactggggaagtcttaggttcattcacagacatgtgatatttgccttttgattcctctcattgacgagacctgtgatttttgtgggcctattaaagttatattatcttcatagaacttttaattaagtttatgcctttcgaatataaggatttagagattatcagaaccatccccacccacaccttcctagagaaacttgttgaacatttgctttgttgtccacggcacatttattacttctgcattgtacgattgcactgtgctgccttgtctcttctaagtggggcttgctttcatattttatgaattttctaatattttgagttctgttattatttatcatacttctacaagtgttgaagcaataaagactcgtaacaattgatgcatttaatgatgcacatgattgctactggactgcatgggtgttaggcttaactcgtttttgataattggactcattgccagaacaaattatctgtttcactcttctgttttaattccccactggctgtaaacatctgtctcacaaattagaaaaagaacccagcaccctagaggccaaggctgtccctggccacagggatagttccctctactccttgctcatgaatctgtgaggtccatgccctgtggctgtcttctttctcctgcctctttttcttcttctttttttttttgttttggagatggagtctcgctctgtcaccaggctgcagtgcatggcgcaatctcggctcactgcaatttctgtctcctgggttgaagcaattctcctgccttagcttccccagtagctgggattacaggcgtgcgccaccacacccgtctaatttttgtgttttcagtagagacggggttttgccatgttggccaggctggtctcgaactcctgacctcaggtgatccacccgcctaggcctcccaaagtgctgggattacaggcgtgagccactgtgcctggccctcctgcctcttcttgattctgttctgtccaagagccctgagaaagctctgtcatcatcctagtggtgtcactgtgatgaggcctgtaggctgtgggtctcagtgggagtcactaacagcatggatcactctgtaggtttggggttgctagaccaggtatgacaacaatcctctcctgaaccctgctgtaggtgccctctgtcctgtgcccaccctttcatttcatacgaatattttgagagagatggtttgttctaaatgttttattcagttgatatttaatgggcttttctattttctttcgataaaaaagggatagagaataagaactctcattatttgaggagagtggggatgagtcagggtattgggcatggattagggcaggaggaacggaagggatgtctagatctttctgaaggcacattcttttgacttccatgtttgttgctgtgagctggccaagtttatccttttttttgcaagaaataaacagaaaccatggagacccgtgtgaccagttactacctgtagtttttttccatacttaagtccactaagtatctgaatttctgtgttgaaagagagtatgaaacctcatctccttttcatatgcatttggtagttgccttttggctgcaaagaacactgaggtttccttatgggaaatgaggtttgttacagggatctgggtcatagggaaaggaggcatctcttcttccctcagcagctggtcatatggggacactcatggcatttctgttctcttggagactctcaattcttttctacccactggctttctaatctcatcatttcagcttgagcttttggctcctgatggatgcccagcctggttacctcctgagtcatcttacatttcatagctaactgacccatctctttatttcctaatttcagttttttgttttttgtttttttttatttgagatggaatctcgctctgtcacccaggctggagtgcagtggcatgatctcagcccactgcaacctccacctcccaggttcaagtgattctcctgcctcagcctcctgagtagctgagattacaggcacctgccactacgcctggctaatttttgtatttttagtagagatggggtttcaccatgttagtcaggctgttctcgaactcctgacctcacgatctgcccacctcagcctcccaaagtgtggggattataggcgtgagccaccgcgcccggccttaatttcacatttttgaaaggacatcagatttttccagttaatctttttgaacaggccatagtacaaccccaggcagcttatgatctggcttgttctggatctttttagaaaagcagggtctgtgggtagtgagattcctggacaaaggatgtggcatctttgctaagatatttaggacatgacacatttatctgtttcctcatttatgaaatcatatcgtgtaatgatgcccttcctgcttcgcaaagttaatcatgaagatcaaatgtgtaacgtttgagaatgttaaaaaattatgcagatgaacattattactaaatccttttctgtacagtatcttaaaatttccccagacatttcacttcatttcacttaaccagagttgtcatagtaaacttttgagtttaatttgaattttacttttttattatatactcagatgtaagttcattgagggtgagaactttgcctgtcttttttttttttttaagggaggggtgttcctttatacctaagccttggcaaagtgcttagttcactttaggtagttactaaaagattgaatgaatgaatgagtgtaagtgggaggaggcgtagtgattgcatacacagattttggagctagattgcctgggttgaagtcctgcttctttcatgtagcagcttgtgactctgggctatttaatgtttcagggcctcaatttttttgtttccttctgcacactgggaataataatacctaactcaagacttattttaaggattgactgagtcaacatatgtaacatacttacatgagtgcttgacataaagtacgtgttttcgatgatgataaagggcagtcagactgttacctgttggtgaattaatttggaaatagtataggaaagcattgttgtgattaatttgtaagtcatttgggaaatgaatgtttgcttctaatgcatatgcagtataatgcctttattttaaaactaatagtgggataagttatataaatagctcacattatttcaatactacatttaatatccaaaaagtaccctaaaaaagtgtttaaaggtattgaactcttgttaggcccaggtgactgttttgaatacctttaatgcttcagtttgggtagctataaagttgcagagtgtttgttactcttaataagatggaaaatcatctagtgtagagcaaggaaaagttatttgcacctgttcctcaaagagcaaattgactttaggttatctcaatacttgcaggtaaaagtaccaatgtatcattatagctaagtatttgagaaaagaataattgttatacatttgtgcccttaaaatttatttatataaaacagctgttcttgattaggctgttctcataaccaagaagtgatgtttcatggggcagagttcagctgaatgtatatctgtggcagagatctgggggatgtgttcccttcacccagttcttcttaagctctgtgccccatctccttcccatttagtacaaaaatttgaaaactgtactgttagtctttctcctcatctatagaatacataataaacttgcttacatgctccaggctgtaggctaggaagctatgtcctcctagtcagttctccagttcctccctacacttgcatttcaagttcttatcaacacagtagttcctgcttacaaaaggctcataaaagcaggctgctttgcttccacctctaagagactggggacttttttggtgggtgtggacgtaactagcgaaaggatgaagtagaggggaggatagagctgtatgcaattagaaatgcagaagccatttttcctaggggagaaatagcaaaaatgatatttaaattccatggagatattcattctataattctaccatattatggattaatttctttttactagccagaaaacttaaaacagcatttatttgtagcaccattgctgtaggaaaatggattccaagttcccaactacaggtttggaaataaacttttccaacccaaataaaatcttcaactaagttgggggtttctgttgtttctttgttgcctctccagacttttgtgatctgagatgtaaaagttctgatttttttctgcttctagttttatcttactttagtacaatgtccttccccaggcacctgggagctttgtatactccaataaatatgcctttgtctcctaaacatgtgcctgtcttctattagggattatgtacttgtctacatttgtcattgatttgggagtatttaggaaggtggaaaatgacatacattcttgtgactttagatgaatcagattatagctgtataatgtaattaatttagtaaagtaagaagtgcttcggctgggtgtggtggctcatgcctgtgaatcccagcactttgggaggccgaggttggtggattgcaaggtcaggagttcgagaccagcctggccaatatggtgaaaccctatctctactaaaaatacaaaaattagccaggccttaggccgggcgtgtggctcatgcctgtaatcccagcactttgggatgccaaggtgggtggatcacctgaggtcagtgattcaagaccagcctggccaacgtggcgaaaccccgtctctactaaaaataaaaaaattagtctggcatggtggtgcatgcctgtaatcccagctactcgggaggctgaggcaggagaattacttgaacccattaggcggaggttgcagtgagccgagattgccattgcactccagcttgggtgacaagaacaaaactccgtctcaaaaaaaaaaaaaaaaaaaactgggcgtggtggtacacgctactcgggaggctgaggcaggagaatggcttgaaccctgaaatggaggttgcagttagccaagatctcgttactgcactccagcctgggtgaaagagcaagactacgttcccctcccaacccaaaaaaaaaaaaaaaagtgctttaacaccatgctgctataaaattagaattctgtagaaaaatcttgcaattcacactaacaagaattttgaaattttggtggtttggctgtagagatctggcttatttctgaatgctaatgactgtcagataccatctatatttgaggaaaataataggaattattgattgaacagcataaaattaaaatcatatttagagatttgggtaactcagaaaggctttaaggacatgtaaacatgggatatcttaaattttaaattattttttgaaaatgaatacatgtttaaacaacagtgaaggtctttgctaggtacaaatgataagcctagaaaaaaataagtgtacaaattcctgctctgaaggagtttgcagtgcatctcaattgggttctaaaacaacttttttagtatcatatttaggaagtcttgcatggttctttcttttgaggaataaaactttcaaagaatttgtagttgagtaattgagattaagtttgagtaagaaaaggtaagttggtaactgaaagttgaaagcaactcaggctatttataggtgggctagaaacatgtaactcgatcaacgtattctataattaatgtttttactaaggttactaagtgtgtgcctgttatttctcattgtccaaataatacaaagttatggtatatcatctgatggaatatttttaggtgaacttaggaataaatgtatatagtgtcttttttaaagataaattattggttgttaattttttatttattattgaaaatggggatgtattttaatgtttccagactgaatttctttggaattacagcatttctgaattattttctattatagtgtaatcacacagtgtcatcacactggatatatttaggcaattgtataagtgcattattaatcctttgtctcctgttattttcttagaacaaggtttatttacagaagaatcaatagaggcctgacaggtagtaaatgaatgaagtggatgactagaaattgcaggcctcagaaaaatgtgggttttggtagaaaatgttagctagaatttccaaaatactgactaaaaaaaaaaaaaaatcccatctgcaggatggatctgacccaggcactaccagtgtgtgacccctatcctgaaggagaaggtggtggtttcagttgtctgtttctgtgaaacataccattccaaaacttaggggctaaaaataccagttttcttttctgattctggaggatcacaatcaagttctttcttgggctttatcatgcaagatggggtcgtcagagccttcttcatgtacacctttgtttggcacttgtgctggttggttatctcctgcatttctcctcctgcattttctggatggcttgggctccctgagagtacagcagtagccaggtaatcagacttctgacattcttgcaggtttaccccagagcgaggatttcgagaagtccaggaggaagctaccaggcttctcatgacctcagaagttactcattgtcacttggctgtgttctattggccaattaatcataggccaacctagattcgagaggatggaggaataggatacacttctcaatgagggaatggcttgcacacagagggaggggaaggagttgattgtggttatctttggtgaaaagctacccagatgtcattctagtctctttgtatctggccttacctgcctttcctgatcttcttgcttgcttctcttatacagaatccccttaccctggagcttgactttaaaatctccatctgtatataaatgcgtatcctatgtgcatttatctcttagccttgctttgttggtaactttatattggataatcttttcgttcatcacgaacataaatgcctcatgcaggggcccggtattattctttatcctaagcactatatagattcaattccccatatataatagaactcaacaatatttgtgaattgattgatacttgatattttcgaaggattgggtatttattgtttgcaggacactttattatacagtctttttttcccctgctaaaaattatgcttgattctcaaaaatgttttccaaaaagtatgtaaatttagattttagacacaaatgccagtttgaatttgggaagaatagagtactgagaaacgagacactcttttaaagtacctaacagggtctataggaagttcttgtgaaatgttagttagctattattctgtgtagtgtaataaattaagctgctgccttcatttgttggcagccaagttgccaaaggcccttgtttgtttacatccagtgatatttactctaagggactatgggacacagatgcagtattttagagtactatttttttgagatcacatgttacctgtgaaaaacatcccagaggctatacaaaaattaattgccagtatttaagttacttggtttttctaatcccagtacagtagttacatttagcagtcatctaataactgttatcattgagacttcacatacttaaatagcatcagtgtaggatttcctttctttcttttttagaaactttcacctcactatacttattactaaaatctatttgctttttgccacacttcaaagaaagggagaggatacgtgactaggaagccctctgagctgtaggtgggtggggcgggtggtggacaatgtttttcccttaaatgagggaactttcttttaacagtactttcagataagaacacgtttatatttctttaaaatactttgtatcttcagcttaggactgccactgtttttgtggggacttaatgcataaatttaaatcatttgtctgtagaaatgatgggatgctttgtcagatcactgaattgctaagattttagtgtaatttagggaaataaaccttcactaattttcccatcccctatgttatagattgaaaattgtgtcatctccattttgcagggagaggaaaaagactaatccccttttaaacttagcttgaagcctgaggcttgaaggcaaagtccagggtagcagctcttaaaatgaaaggcccattcttatagctatttacacatctcaggagagactaatactttgttaatccacttaaagcaaaatttcttccataaattgggtttagatccctgtttcaaaattgtgtgttggacactgttaacaggtgttccattaaaaagagttttgtggttcaatatttggtgtaaacaaagtttactgcagttagcaagcgatgagtttctgggaaaaaaaaatagtttactgcaggacttcttgtaacatataatatcctggtgaatattttgaatctctaaaagagagatgcagagactttgtagcaagtagcatattccaaattttttttgacctagaagccattattttttttttcagaatagttattaccattgttccagggagcacaatttgtgaaattcccaaacatggctgtcgctttatatgtagaaaaatgttaaaaattgtacattttggaattagtcagatattttaggcttttttgtaatagtcgcagttgttaattttttgtagctgtctttcttgtgcttgctaccatatgctttacagatattgacaagctttgcagaatctccaccttggtgaatgtatttccatagtaagaatatttctttttaatacttaagcttcatagaacacaagtctttcagcaaaacattttttacttaatatcttctatagagaaaattaatatttatgtcttcaaacccaataaaacattttaacctaaatgtgggggaaatatctcaagtgacatgttgaaaacaatacacagtgtcagctaagaggatatatgccactgtcactgcctagaagcaactcataatcttactaactggtcttcagttaatagcattttaagcgttttgtattccaacatgatagtttctttattcgacatgggagttttgttgtgtatgttttagaaactggttgagtatcttggtagatgtgttacaagtttttccacttaaaagtggcacagtttcagtgttttcttgcagaaaattgatttttaggtaaggatcactgccactgagttggagaggctatcttacctcatttaatcctcatagcaacccattcaggctggtggtattatcctcattttactgatgatgaaacagaagcacagaggtaaagtaacttgcccaaggtcacactgctattggcacggctgagatttagacctaggcaatttgttgtcagggtctttaccaatgtgccattcagaaaaattattttgtttctatcttttgtgaaccgaatgctatttcttcaagtgtatacagagcaagttaaaagtacaagggaatgtttgcctgtctggtagtttgtgtttgtttttgtaataaaagctctactccctttggtatttggagaaagttatgccagtctggattctaggcaattcactggtagtaaaataggtactttgggaaatcaccttaactgctttcaggcgccaagatgctatttactacaatgaagtagtaaatacttctacaaaattctgccatttagtaaataattttgtgccgccttgacgtcgactggcatttcatggtcagctgttcgtataactggggcaaattgtatcatcacagaaaagaaaaatatatattgagcactctctaattctaagtactttaagatggaatttgtttaatcctcataagatgagaattattatcctcatcttaaaactcaggtacatgaaataactggtcccagatgacatgacctgtatgtagatcagctttggtttgaacctcagtcattttcattgtactgagaggtgtacagtcagtgcagttattgtttttctctcttcagtgtgcctgtgtctgagtggcagtggggcctcagttcacagggaggacattttctatggcaggctgtggtctggctcttcctagcagcatttggggtgggccatggctgtagtgggggccacaggaaccaagggggaggtaagaattcctgtagatagagcagaagagaaagccctaggctggggccttcttctctccccattagtaatcatttgaaaactggaaactccatagatgcattaaaagtcttccggaaccagcatgacacagaaacaagatatgctttgagaacaccactgccaccaccaccatcactgctggcattaatggttgtatttttctttagaagatgaagaatcagatcttcttaaccttagaaatagtatagtaagatgactgtgagtctccttatctccaggtcttccccaacaatctagattgtttcagtacccttgctgttgcatgagaactttccactgaaatccaagtgacaattctctttgggtgtgaaacagcttggagttctcacagttaccgatgaacagctctttttcatgtagtaaagccatttatatatttcagggggacagaaggacattaaagtcttggcctaccacagacccaaaggttctaaaataaaatgacctatttggtggttcaaaagtgcctttgattaaattactggatatttgagaaggtgatgaatgagggctggctggtgggagagaatatacttgtaataatcttttagtcatggatctttttcatagcatgtggattttcttggtttataaatattagccaagtgatcaactcactgcagctctttgaggagcttctccatttttaggcgaagtaatttgaaagttctcaggaagccaaaggtacggggattgccttattcttggtcctaaacctagacctgttttataaatagatgatttccaggccaaggtgtccctgtatgacatgttcccataaatgtcctgctgccacaaattacaaatcttggcaaaaatagaattctgtgtccactcaaactgttgctgctttcctaggatgccatcccatgctgccttttccctgtagagttctgtgggtgatgtctgtatgtttttgtctgtatgctttcatatttatcccctaaaattctgtgcctgtttaaccaccttgacatgatatcatttctccgtacccaggcaaatggtttgtatggagggatcttccaaagtcagccaacctagtgcagggaggacaaggagagggaaggaaaatatgaatgaactctgtgttactggggacccaggcatgatggaatattcttgagaaaagggtctgctcaggcgagcttaactccctggacagcctgcctttgaggagaggaaaggaaggaagcatgcattttgtaaagagtaaaacatttcacaagatactgaaaacaaaatccacagaaatgcccaggctgcccagcctttgacttaggccagtaggcccagaggttgtcattcaaagaaagagggggtctttgggtttcagggccaggaacagaaaaatgggcaggggcctggaagaggagaacaattatggaaggaaagggcagttgctcctcctctgtcactttgcagaggtgctggctgtgtcagtgctgaggaagccccaggccaagcccaggtggcccctgagaggatactgcctgaggcactcctggcaatggaggtggcttgcaagaacagccaaggactggagaagccagtgtgggctgagcaggaacggggatgtcagatgcatggacatagcacttcctggagcacatggctgcagggaggagtagatgttgcccctcagaagccttttgggaaccagaaaacagattgggcagtgggtgggtgaggacttccacaattatgtgaatgtagtatcagccagagaccttttgtttattgccattgttgggtagttcacacctccgagattatgcttcctggttaggtggcccgagaagcacttgtttaggtatacttttaaaaaattttaattgatagcgctcgaatacagaatgtcacttacaaaactttgttctgtgaacccttggccagtaagttttaacgcttagagagagccactcttcaaatttctacctgaaatcgtaataatctaagcatcttgaagaaatgattggaagtgaattttattaggaaaaaactgcttactcagcaaaatgttaaagtgcacagaattctttttagattaagatagatctttccatggagatgctaaagcatttctgcatgattcaatattttcccacccccgagtactagttttctttttctgtaagtggagttctctaggcttctaagggccccatgctggtgagaactggggccaaagtctgtgtagtctttatcaaggcataaggttagggaaagtgtgtgtttatgttggaggtgactgtttgggggtcattcacttccttccttcccccataaacatactacctgcttcttccccatctcatttgtattagtggactaaattaatgattgaataaccagttgaattgtgaggattttgtgcaataatattacatgcattgtattactcaaaggatcagcttatattgagcccaatatataaattattgagatgcaaaacaattgttatggggtgattttgcattcgagtagcatttaaaaaatacaattcaaaggtagtttgtattgaataagtaatgatagcattgaaatgaattttcaatttcaaagattttaagaaaatctttgaaagcatataaattttgctttattcagatgttgtgaaatattgtgaatatttgaaattgtgaaagcatataaaatttatttggtctcacatgaatcttctagattgtgacatacgttattaagctggtgaaattatagtatgaaatgtttttcttttcacggggaggaatatgaaatgctagaaatctatatatgctgtattattgatatgtatcctctaatcctgaatatcttcaaagtgaatatttatagtatttaatattttatttgcattacatattgggaaaaagtaaatgaaatattatttgtttgaaaatgaaccttatctatagattctaaaattgtacttgtgagtaatgtagacaatcaactctctttagtctctgaattgttatgttttattgtatttgcaacatgaatcattttgcatttggagaagttatatgttgtatgtaataattgatgacttgagatgagggtaataatctaccacttttgtttaagccacatcagatattaattgtcactatcttaagcatagcatttgtaggtttctctctgataaacatatatttagttcagcagtggttttattcatttttgtgaacggttacactttaggcactgcatgtatgtgaagataatataagtattatgaatacattgttggtgcatttttacttacagtttccatacaaatcattacacacacaccacatacacacacacacacacacacgtttacatgggcagaacatttatgttgattttgtaatgaataaaacattataaacggactgtttggccaaagtgcttatatgtctgcttattaacataagattaacataagactcataatttaaatagatgtaattacttaaaaatgaatcagccttctttagaaattagatgacaagtttacttacatggccaaacctctttgtagttttggaattcagaatggaaatttgaaggctggatgccaggagtgtgggaggtacacaaagaatcgtttttccaggaatgctgttttccaggtttctgtgaaaagcaaatgcgtgccttttctgagtgatgaaatagaggaacagaaaggtgtcaatatatatgtattctgcttacacactcacaaggattcctgcaattatgctgaaagggcattttaatgcgaacctataatgtttaagtggattcttattcctgtattcttgaggaaagtactctggtgaagttttcaaattcacagcaatgtatgcctgtttctccttcttggggtagttaaaaaacaatacatgcccatttcagcactttgggaggctgaggtgggcagatcatttgaggctaggagttggagaccagcttggccaacatggtgaaaccctgtctctaccaaaaatacaaaaattagccgttcatgaaggtgcatgcccataatccaagctactctggaggtggaggcaggagagttgcttgacccgggaggcagagattgcagtgagccgagatcacgctactgcactctagcttgggtgacagagtgagacttagtctcaaaaaagacaaaaaacaaaaccatccaagcaaccaaaaaaataatacatgctggtttctcttatcctcatgtgagagggaaatcagagcttctcagctgtcaggtttctccttggtgtctttcaggctggagactggtaagtttgttcccaaatgcctgacaaggcctcagagatgatcattagtggcagcacccatttattcctccagaaatttcagatttgctcccttgattctgcttgtttaataaattccagacaaagaagagtaatagcacatacgttttgcatgctaaagaattacttagaatttgcctcttgttggctctgtgacattgagattctcaaggagacaggaagaaaatagaagtttttatattagacaatagttagatgcagtgctcttagcatcagtctattgaatctccaaaatatggaatcattgtcactggtagcagctatatttggatttcattagccagtgtagtagctaccaatgataaggcatattttttttttttgacttggagtttcattcttgttgcccaggctggagggcaatggtgcgatctcggctcactgcaacctctgcctcttgggttcaagtgattctcctgcctaagcctcccaagtagctgggattacaggcatgtgccaccatgcttggctaattttgtacttttagtagagacagaatttcaccatgttggtcaggctggtcttgaactcctgacctcaggtgatccacccgcctcggcctcccaaagtgctgggactacaggcatgagccacggcacccagctgataagacgtgttttttaaaaactgtgctgtggtaactccttggagtttgttaacaggtgctttatgtactatcccatgttttctactaaggatgataagcactgtcatatctgtgttacaggactggaagttataattattataatgttacatcatttttaaaccttgctataggtgtttacagaagaatgacgtcttacatccaactaagaagatcagagaaagtttcaggtttcatcttgctggagcagttggataggattgggttttaggggaaaaaggtaaatacattctgaagagagagaagtttggaagggagctgatatgtaaggatgctgacgtggctcttggggaggagaagaaaagactggaacgagaggttgaggccactttgtggaaagtcttaaaggtcaatcttgactgaagaattgggatttcttttcatccatgtctgcttgtgaactgcccactcttcagaatacccaattgctccatcatggatcactgggtctactgaactggaactgttctgatggattgacactgtagtgggaagagggagctctcgatgacgagatggcatggttttgtatctcagatctacccttattggttaactgaccgtgggtgagttacaaaacatctctgtgcctcagtggtgttgtgaagatttaagtgagctaaagcacacaggcccactggaaataacttaaaaaaaaatgtttggttactattgaacttcttatgctatctgagacagttacctcctctgtcgtgtcatgaacatagttttcaataagtatgtggaagaatctagagatattgtgatgagagagggagatggtcaacacaggttaaggtgtgggttagaggaaagaatggcaccttgtatgaattgttgccacttcctgtctgaagcctgctttcctagagcaaagatcctctcctatttccttcacttgttctgggaagagaatgaaggtgcgtcctcagtacagccctgctttgatagggtttgagcctgagcccaggtgtcctgatgagtcctgcttggtgcctgaggaagaagaaaagggttgttgtggtttgtcagccccagacaggcaggaaacgctttcttaacactatgtgggtgaggtttcagctatatgctgtgtcagtagatcctcagactcttggcatttccaaacatttgtagtttctggcatttgcagtaatttggaatgttggaaactggtaacttacaacttctctgagacccgtgaactagagttgcaagtcctaaaggtggggtgcatagaaactggtccctgcatacctgttcaacatctgtagccaactgtcatctcaaagggatgaaactgtgcttgcaaagaatggttttatggccaggcgcagtgactcacgcctgtaatcccagagctttcggaggctgagttgtgtgaataacctgaggttaggagtttgagactagcctggccaacatggtgaaacctcgtctctacaaaaatacaaaaaaaaaaaaaaaaaagaaaaaaaaaagaaaaaaaaattagccaggtgtggtggccggtgcctgtaatcccaactactccggaggctgaggcaggaggatcgcttgaacctaggaggtggaggttgcagtgatccgagatcgcgccattgcacaccggcctgggccacgagagcgagactccatctcaaaaaaaaaaaaaaaaaaaggttttattagggagggaattcagtgaaagatgacgggatgactcccctgactcctgaaaaatatatcaatctggagaaagacaaatccatataacttataacttgtaacacttaaacacttctatagttgcaaatctgaggattctggaagttcagcccatatttctctggaatatccaggtgggtggctttctcagtatcctagggaagagactgaactttgaagaagtcggtgccctgtgaggagccaaggcagctctgggtaagcgtctggtctttgccagcttacctgcgcagggaacctctatcctcatatcttactggtggagtggtaggctggaggctcctctgattggtgagatttggaggtgaggtaagctttcagatgctccctgaacatcacttgtagaatgtgcagagagtcttatgggaatggctgggaaggcaagctcactaggagatgagcagcccagcctgtaggggacagtgcaaaggagaaagtggctgaggaacacagggcagccatggtaggagggtttgggagcgtgggagttcatattttacactatgttggtacttaccatgcaaatgaacggccctgctgggaaaagaacctttatccagagaggggatccgaggaaatagtaagagttgggttccgagaagctgtgctgcatcacgggagagctcggtgttagggtcttttgcaaaaacccaaatttatttaattttcctttagcacagacttttccttttcttttctgatttttctgcccctccgcccgcccccggcaatgtaagggctgaagaagcatttttcttttacagtggggtcaacttgcttttgattttgaaagttgttgccaacatacaggcagggttgttgcaaaaagacttcttcgtttcctagaggagggcttgagtagggagaaaaccatctggacttctcacttctgggaactcaagtattaactaaattcatttttgtgtgtagatcagaggggaaaataagaggaagtgggagaggaaaaaaaaaagctgccttgtatttttgaatatggaaaaaactatcaagtgatcaccgtgatcagcacatttaatggttgcatttaagtctgaatagaatttttgagaaggctgggcttttttgacatctctttttaatgaaaaatatgtaacaataacctttatacagtaccttcaatttgcctggtattgtgtgctttataatatcctatatttgaatattgactcatttatatttcacaattttttttttttagacggagtcttgctctgttggcccagggtggagtgcagtggtgtgatctcagctcactgcaacccctggctcccaggtttaagtgattctcctagctcagcctcccaagtagctgggattacaggtgcctgccaccatgcctggctaatttttgcatttttagtagagatgagtttttaccatgttggccaggctggtcttgaactcttgacctcaattgatccgcccacctcggtctcccaaagtactgggattacacatgtgagccactgtgcccagccctatatttcatgattctatgagagtaggtatagttatggtctctattttatagttggggaaaccgaggcccaaaagtgaagaaaacttgctcaaggtgacatgctaggaatgtggtggagctgctttgaaaccctggcagcctggttccagaggctgtcctgttaattactacgctgtgtccagtgtccaccgccggagtctgagaaagcagtaatgacgtttctctatttcagtgaccttgcatattggatttgcccagtttactttggaagtacccattccacttttctaggatcatgaaacactgtatttaatactcaaatatcttagtgctgatatcttctctgattctagagggcatttcacagatcttactgaaaaattccttggggtagtattaggcttcgggttaagtaatttatttattagacaaatttcttggctttcatgatttgggtaaagtatggtcaatctgtgtacttctgattatatgctaaacacgtgaaagtcaccagatggccaactacgatgattcccatggacttctacggatatattaatgctgttttggaggaccctctgtgtgccgcaggctccatgacacctaatgttggtggatgcgttctggtgtgtatgtgtttccatgaaatttacaaactaacacacagcattctaacatgttcacttaggaactttcaaaactttgccctacaagacaacattctcaatagagaaaatttagaaaaatagcagcacaaaagaggaggcaaaagtcacttatattattaatataatactactctagagctaaccacaattgaattttattttgcctcagtatttttttcccatgcacattcctaggcatgctatcttaaagcaacagtttgtgtagttaatctgttgctctccccacagttatattttaactagggtactgaatacagaacgttttgcacatgcatttttgctggagaaaccacagatatgtagccatttatagtgtttcttagctatcgcatgcatcatttcctctcctacttcctcctgtcactggcagtcctgcagctggcctgccttgccactcctgacatctgagtcatcactgacatctctctccccaggcctgctcaaggagctcttactaagctttgttatttttttctctccaagatttttcagatctgtactttatttttcaacgccccaactcaatcctaatctgcacttcaatcatctcgcgctgtcagtgtcagtttcttggctttgagctccttctcttttcaattcacattttcaaaagccattttctcccaagtgttttctcacctttcctttcttagcagaactcccccccgccgtggttacacctccacgttactttccaggtatgcccacatcattttatgattcttgatggtgttctcattcaccatatccactttgtgcaaggcagagatacaccttgctgctttgttattgcattgttgtgaaaggtaaattgggctggccccagagaaaattgtgaaataaggaaagattttgccatctccaacctctattttccattacatttttgactcatcagggcttttttcttctctgacttgttatcattccgctctgtaattcatactgctaatcaaaatatgaaaggatctgatattggttgtttatacgtaaatgaatttgatcacaaattattaacgtgtgatcaatgttttaatgaaatgaagctaatgcaagtagatatagtttttcatttctacgggaaaaaaagcccgtacttggcagataaaaaaaccaacaaccctgtgctggttccttccacctcaaattaaaagaaaaaacaaggccgggcgtggtggctcacgcctgtaatcccagcactttgggaggctgaattgggcagatcacgaggtcaggatatcgagaccatcctggctaacatggtgaaacccggtctctactaaaaatacaaaaagttagccgggcgtggtggcgagtgcctgtagtcccagctactcgggaggctgaggcaggagaatggtgtgaacctgggaggtggagcttgcagtgagccgagatcacgccactgcagtccagcctgggtgacacagcgagactccgtctcaaaaaaaacaaaaaaaaaaacaaaaaaaaaaaaagaaaaaacaaaacacatttctcactttttttttcctgaagtatataagtctgtgaataaccatggtggtaaaaacagaaaggagaaacagaacgagaaagaaagaaatagaacaatcaatagaatatagtaatattatcaagctatgtcttttgattaaaatgtattatatggtttaccttgattaaaatgcattatgtgtgcagttttctcaaaaaaattcttattgtgttttattgttcagtcccttgtttattctcagctgtgtgtccagttactctatccatcttagactataaactcatcaaggcattaaacatgttgttttctttattcctgaatctcaacatctagttaatgccaggcaggctgtggacagtcaataaatgtttgctaattatgtgatgatgctttgggacataagaatgttgctttgtgtctctagggttttagtttatttttaccagatcaaactttagaattcgactaacactaatgtcagaagtctgtgtttcagtaaccatctacagataatggcacccagttgtccatgaggagatgccatttgcatcctgtgtgggtgacagctatgctttgattcctcttggatctgtaggactacttgcctgtaagacctcatgtattgttctgggggtctgccagagagggaagctagcctcagaacacggggaaatgaggcaagggggcttcagaagtggtcatgtcaggattctggcttggcaaagagaaaggcgtgggttgttttatgttccaaagctggagttatttcttctgtgaccctggcatgtcttcatacttaacagacaccaatattgtcctttccttggtttagccaaaaccgggggttagggtgggtagtaggaggtgaaggagcttttcttcagtatgtatgaaggggattgacgtaatatctgctttcataaactgaatctccagtgagccttcctttaaaaaataattgtatgtaaaaaccacataatgattctgtaattacagtgtgttggcacagttgttaaattataaatttaataagctaagatgagctcagtaagagtataggcttttcactggagtgaaaggacattacttgatgagatacagcagagaggaaacaatagactttttgtgtagctgcctgaaacttctgctaggtgaaggcaagccaataaatgaagaagaagggataatggattgcctaacctgtgaacttggtcaccatgttctttgaaaacaaagtgaaatgcaatgtgttgtctttggactgtctcacagtgcttaccctacatcagacaacccttgtctagtatttcacggattttgatttgctatttattttgcatttgccttcatgttgctatgttttaagccatgaaatgaattatttattctgtttatacaagcaaaaaaaagttaatagctcaaataaaatgggaatatatttgtaatggcatcatagtatatgatgtggtatttttattcttgcttaagaggctgaagattgaatttgtatactaattcagatctggagagagaagaaagtagatggggcttatatacaagcagtcattgaattattgatttatatgtaggttttctacctcaggatgttttcttttttggaggacactgttaagtattaacaatgttaagaaatacttctagctgggcgcggtggctcacgcctgtaatcccagcactttgggaggccgaggcaggcggatcacgaggttaggagttcaagacgagcctggccaacatagtaaaaccctgtctctaccaaaaatacaaaaattagctggacatggcagtgcgtgcctgtagtcccagctactcaggaggctgaggcaggagaatcacttgaactcgggaggtggaggttacagtgagccgcgattgtgctactgcactccagcttgggcaacagagtaagacttcgtctcaaaaaacaacaacaacagcaaaaaaaacttctgattaaggatcttggcaagtggattctagaatggcagcaattctccatgtccaggaaactagagaaggaggcgagtcaggattatggtgggctgtgttacagttctactcaaagggtttatcgggaaggcagagatttggcccatcctccactgctgtcattgctgaagtacaaagtcataatgcctcctcactgttttccttggagccctgaggtccatacatactctctgggttatccatataattttgcctttaggcttttaggctctctagccaagaattcctttttcagttaaggaaaagcaactataaggagcatgtcccctggatgaatgccatgttactcttccagttctggaaacgatctggctccagggtaccaccagaccaggcttcggccttgcccagatttacctctgatcctaaaggctcctgagaactggccctgtgtagggggctgcttgctgagctttcttgggctctttctcccaggattaatacagtgcagtgtcaagccagagttctgaaatgggtcagtaaaagttacaggagctgttcgaaaggaaatttgaggttattattgaggaggaaggagagggggagaaaagaggtataatattagttttaatttgtatggtacttcccagtataatttaattaaattctcaccttaaacgccttaaataacttaggagtagagaaccttgcttttggggacctattcagaagcagaaaaactcttcagatatgtttggagcagaactgtaaatgctctggcttagtaaatttgtattttttttcttattaccctttttcattcttaggctttctgtgtaggtatgattgtctgatagtggcttccaaaaatttttaaaaaggtcctaattcacagaagttgtgaatgtgaacttatttggaaaaagggtctttgcagatgtgattaagttaagatcttgagatgggaaattatcctggattatccagttgggtcctaaatgcaattacaagtatccttttaggtggcagagggagatttgatatgcagaggagaagcatgtaaagatggaggcggagattgaagtcatgtggccacggcaaggaaatgctggtactgccagatagacactggaagaggcaaggactggatccctagaggcttcggagggagtgctgccttgctgacaccaggatttcagcccagtgatcctgcttttaaatttctagtctccagacttttagagaatagatttcatttgttttaagccaccaaattttggtaatttgttatagcagccacatgaaaccaatgcaggagggaagagaaataaaaacgaaatggaaagcaacttgttcaggaggaccctaccaccaaacttaattttcatgaaagaacaccctgttgtttacttacatgtaatatcagcttttactacaagccaggcttagttgaattctgatggtcagattaactttccaaaagcagccctctaatcgtgtcatgtgtgtttgtctgtattcccaacataactataaatctgggatcgtgtttggcttgtgtataattgtatccacattacttggcatgtagtaggttctcaataaatattttccaaatgagtacatgcttaagtatgaacattttagaaatcaggactccaatctgcttttccggctatgtttctccctattctttttatgttcttgccagggaaaaatatcaagttggtgatagataaataatgaataataactacagttttgctatgaataataactgtccagatgacagatggcactagtttagactgattgaagaatcaatattaattggaacatttttgttgtatctcttaagagaaagtggcaaattaggacaaatcagatgaatagtaaggatttattttaaaatgtactttaaagtgtgtttttagggtcagtagagataaaacccaaatggatcctatgcctacagtattctatagagacaattgatattcagaataatgtaagtaaggcactggacttcaacttttaaaaacattaaaaaataagcattgaagccaaaagagtttattctacagtttattaagctacttagtgaattcctaaacatttcctatcatctgaaagtagttttctgtttgtgatatgctgaattttgtacctaagatagtatcttgtctaagatgatcacatgagcaagatggttaatattgtttcctcaactttttattttgaaaaatttaagcacttagaaatttttacaatgggttaatgaatacatgtaaatcttatgtctatatttgaagttttaaatttagaaaaatttaatactacaaagctcagatcacactccagataaattaatctcaatccctgcatgagtcacaggcatacgtattttttgtttgtttgtttttggtgaagctcccaggtgattctaatgtgcaggcaagtttgagaaccactgcactgtaccattatcacaccaaagataattatggtctaatatgaaggccatattaaaatttccacaattttcccccagataccttttacatggttttgtttccaaattacaatgtatttggttgctatatctccataagtacagatgccagcggctcctgcactttgccaggcatccgttgagtgtgttgtatatgtttgagcaatatttttgcctgtacagcttttcttgagcacaaatgttgtatcagcatggatttggaaaagagatcaatagagaactgcaactttctaatccataatgcatttaagttcagatatgtgctcagagatgtaagggggaattttatttcatgttttgtgtaaatattgatcggagacccaaaagggcctaccttacagacctctggggttcaatggggcatggtgtgaaataacacacacttgaagtttgcaccttccccaggctgagctggtataacttgtgtgcatgtaatcatctctctgttatctgacaacaacaaggacaattctactttggtagaaatgtaaggcagagctgataaagaaaatatggatgatactcataggcaagttttgttttttacctttcaagtattgctatcttgcatttcctttccctttcccacattaaaattactcatagctttggtggtaatattattgctgtatgggaagcttaaataccagccagtggtgggagtgctgaagtttgggagcaaaggtttctgtgcaaggacaaggaaaaatgatgataggaagaagtgacttgtgaacagtgttgctataataaaagacaagagggttggggatgtgtgggaaagagccaaccagcttttcaaggtaccttaatgataacagaattctgagaaatagtgtagccattgttattttacgtctttcattgaatgttctgtaaacatcaataaggacatttcctggagtttgttgaatagcacacacaaatataaccaagagatacaatctaaatgctttaaaacagtgtctcatttcttctagagtcagaactttaaattggtatactcagtgaaagtgagagtgcaccaaactggctaaaactagctacccataaccataagttagtgtaattattatgaacaaggaaagaagggtagatggaggtatattagtcaacaaaagcaatttttttttttttttgagacggagtctcgctctttcgccagggccggactgcagtggtgcgatctcggctcactgcaagctccgcctcccgggttcacgccattctcctgcctcagcctcttcagtagctgagactacaggcgtccgccaccgcacctggctaattttttgtaattttagtagagacggggtttcaccgtgttagccagggtggtctcgatcctcctgacctcgtgatccgcctgcttcggcctcccaaagtgctgggattacaggcgtgagccaccgcgcccggccaacataagcaactttttatttaaacttgacctttggcacaggactctgacagtctccctgaatttacgttttagatctggcattgccatttatcttatctaggcttagtgatacaaaaattcagcggtgttactgtcccggaatcctctattttccttccttaaaaaaaaaaaaaaaaaaaaaaaaaaaaaaaaagaggacaaaaaatttttcatctgttttcagataaaccactgattgataattttcaaggatattacttttaccttgcagttatagatttttgtgtttaagggactttgagtctcgtttggtataactttttttttccacacccaaggaaatgcaggttggagcggtaaagtgactagttggggagctcgtgtctaactggtgatggaaggaacagaacctagaatccctgatgagtgttatgcagtgagtgcttgctcaatgcatcacactttgcaggcgctttaaagagtattattgtaacatttaaaagtgaagctctataaggggtataatattaagctccatgagtagattgagtctttccattccatcttcaggatgggaaaggaatgttttccatgtgagctctaactgtggagatgccaggggtgtgagggctcataaaccacctacagttgatttttggacagtttgatggtttcatatactagtgaagattcagtttctgaataccttaaacccccttgaatagactgaccctgtgatgtaggttctaatggtgttattggacctgttgccccccctctgcaactcattagggtaatttaacctttgtgggtggttagaaagcagaaataacagtccttaccactttccctcgttagaagacattgactacttttgctacagattactactttcccatctattaaaggaatactgaccaactgcataagatgtgaggaagcttggccagttagcagctctcctcattctctcccacctttcttaccattcagtagcctcttctggaacatagccaggaaagaatcagagtctgacacttgatataatggatcaagtgcctggccgcaatggcaccaaccaggttttttgggtggatctgttttaaacattgagcagaaataagagctgccatttaaaatgacccagtggccccttattgatcagtccttacatgtgattcaattgctcctccaattgcggacaagaatggaggagggtggggtggagtacggtggagtgaagtggctcttggctaaacttggtgtaggaattggtctaaaaatggtagctatttgattgacagctcaggtagacatagggacgtatggaggggaatttattacctgcatctctaggaacaaggaaaaacaattaagtctctatttcttattccctctgagatactctctcataatgtcttagggctgggaacccagctgtttccttgctcttaggtccatttatactaagcagggaaaaggcaggtggctgtgctgcaagagatgttccagagagaagtatccatcttttttagatgtctgtggtaaatgcttttgtgggctttccagatgacattgccagataatggaatgtgaaggctcctccaacacccgcccacaccttgcagatgtgaaaaatgggtgttagggttatgtagctcatcagtgtgagattgaactaacgtccacctattgccactcaacctcttttttttttttttttttgagatggagtctcgctctgttgcccaggctggagtgcagtggcgcggtctcggttcactgcaagctctgcctcccgggttcccgccattctcctgcctcagcctcccgccactcaacctcttaattagagactcccaggtgagggggttagccacctgagtgaactgaaggtggattgcctggggtctaagtccagatctcccacttacaatgtgacattggccacgttatttcaccacttgtccttctgtttctcaactgacacattggaatggcaagattgtaaggagtaaacgcaaaaatacctgtgcagatgtttaagagtcgctggcagatggtaagagctcagtaagtgtaagctgctggtatcatttcattattattgtgttccctcatggctgttttgctctttagcaattttgtcaaaatttttaaaatgaagaatggaggcgacaccttataaaaatgaaatttgtgaaataatcatagattcagttggccacacttaatatgtgatagcgaactgatgtcacaaacatcagggatttataatttaactcttggggagggcctctgctgaggggctaactaaacataaacagtcctcacttggtatccatgggggattgattccaggaacccctgaggacaccaaaattcacagatgctcaagttcccaatataaaatggtgtagtataacatatgcacatcctcctgtatagtttagatcatctctagattatttataatacctaatacactacccatacatcactttacttgcatagattcaacataatactcagtgcacagcacatttaagttttgctctttggaactttgtgggatatttatttttcctgaatatttttgatccatggttggctgaatccacagatgtggaactcatggacgtggagagctgactgtttatataagctgtttaatcagtcgtgtcacagaaaaataattcagtacattttttgtagtgtcctagaaccatagaattttaaagtttaaacggataccatgttcatattctcccttggttttcaaggaaggaaggaggccagaaagattaagtgacattcaagatttcacaattaatgatggaaccaggcaggcagcctatggtgtcttttttaaagttgtggacatgtattacaaatcttcctgtgtgcctccttccttgctaacatcttacacttgtttcttcaataccaggtggttataataatgagaattttaatgaatacttttcatgtagataaaaattgttaattgaaattttaagacagtttataaaatactataataaaatatatttccttagtgatggggagaggtagagttgggaagaagcttaaaacaaatcagtttctatctttttcaaagaggaggagtgtgtgtatgtgtgtgtgtatgtattactctgtgggcctagagattaaggcagtgaaatttgagccagtacttttgaaactttctctattttgtcactcagtttagaagatttgagataatatatctacttccttttctgcattgcagttgtatttaaaatatattataaaataacctaaaagaatagaaatatcagattttcaaagttggtgaaatgagttgttattttggatttttgactgtggtcttttctgcagataccattaaaaagagttaactgatgtacattaatttaagaagcaaatggtaaaaataagtgcatgaaaagaatagaaataattgaatctgatcattctgatcattcaaggcatttaccatataaatagttgagatctgagaagtttcattgagacagataagagcttaaaaatgtatgaatcattgttgactaatagttaaggcatgcaggcacacttagaaatgtgatttcctttactctatccttcctataaagagaaaaaacacttttaaaataaacctggtttgaaaccaaaatgctgtacaacttaaccttcatttgggacattgatttggctactctatttaagactttttttttttttttggcatgactattttgtcctgggaagcaagctgcagatggcttttgacttggggaaaaaaaaatgagaaagaaattaacaagggaaataggaactggatatttgtattaatttccatgtagtatgaaaatacgtagcaaacaaaaatatttccatttttaagcactagatgaaggacattgtgaagcataatagacttatctttctaaaatttatgcagaagcatatttttaaagaaaaacaattctgatcttttgaaaggtctgtaaatgctatgaaatgagtcattggtgtattcaaaagaaactgggcaggaagtggagagacccatgtttcagctttctctgcagacaactggttatatcactggagactgcttgctcccttctctgagttccagtttctccatctgtaaaataaaatgacttgactaggtaatctgtagatttctttcttctctgaaagtctgtcgttgttaataagttgagaattcagagattaatatgtgctaaggtcttgaaagctttactgaggatattaacaagaaccagattttgaaggaaatatgttttttgagaaagagggcattcttcttagccatagagcatgaacaaagacattattggaaggagcatcctcattatttattgcctaattattataaaagcaaagttgtttcctataggttgattgaattaggcattagctcagcatactggggacagccattggaaaaaaatgtttaaacaactagaactacactgaatagaatcgtactgtgtttggtgagtaggaagtattgcaagcctgtgtagatatggaacttaatatacgtcacacttctgtgtagtaaggactaaggaaaaagccaacagtgggtgtcaaccaagacccatgttacacataatgggtaatgttgagggagcaatgctgaatgagttctcttgggtgctgagttgggagtgggaaggaaggaactgacataaagggatggaactggaaggtcccagagacagtgaggaggctgtgctaagttagagatctttgtgatctgagttaaggccaaggttgtggccacattagtgagacttgatgtaccgtggagagtaaggttggcacacacaattcagaagaacctgggatgggtggggtcagagggacacagacggttaaatttgaatggcgatgattgcagaggacatagatgaaaaatctgagccaggagtagaagaaaggggagaggaagcgtgtgtgtgtgcgcgtgtacgtgtgggtggtgatatgagactggtttctggaacccactttgtcatggtttgtgacctgttcctgctgtgagtgttgtaatcacttaacctctccgaacttctgtgttctcagaggcaaaatggggtgaactagatcagtacttctcagtagtgccctctaaagggtattttgagaatttgtgggggtgttttatgttgtcccatcatttgcagggcaggttccagctgtgttagacattctacaatttcaggacagacttgccaaacaaagaattgtctggtgtctagaatgacctatttggcattcctgagaagatgtcatgtacaagtcagtctcacctctgcttaatctaactcaagttttttattttttatttttagagacagagtcttactctgtttacccaggctggagtgcaggtaaacgatcatagctcactgtagcctctagctcctgggctcaagcaatcctcccacctcagcctcccgagtagctattaatagaactataggctcacatcactgcacctgggtaatttttaatttttttttatagagatgaggtcttgctttgttgcccaggctgatcttgaacccccaggctcaagcagtcttcccactttagcctcccaaagcactgaggttataggcataagccactgcgcctggccctaattcacatcttcatttgtgaagatgaacacacgtgtccctttatccttttaatttttgtatttctcatgcagaatgttttctgatcttatttttttccaaatgtgaactcattctataggtaaatataataaacagttgaccacttcattttatgtctgttagtgtccaggcacatattgagaaacctattttaaattattttcctttatttctccttaatattatcataaagggcatatgcatacacacaggattatgtatagataaattacttgaactttacttcagaatcataaaggtgaagattataaaataggtattaggttaaagacaagtgtgttaaggttgacagccactgaactagagggtgtccatggcttctaactcctgacatctctaagatactgtaactgcaaatgttatgatttgaagaggtaggttttctatcttgggaagggcttagtactgggaagtgttaaaaactgacatcagattgggaattgggtaaaagtcagctacttcttgggactccaggaaggcctgaggaagtagagatctgtgtggaggggaggaacctgagggggtcttgacggggagctgggttcctgctgatgccagcaggtgagaataggggagcagagcattgtgatttggcagctcctagaggaggggagtaggctgagaaagtcttggtggggggaggcagtaaaaaaaaaaaaaaaaagagttacgacttcacatacttttggtgaatctgaatgagtctccttttgatgcgaagtaggtggtataagagacttttcaaataatttaactgtccaccaacgtagccttctcttcaggcagtttgttttgcttttaaattatgagagggtaccaccctccatcctcggtgtgaatattctctaccagaatgcaggaaaaacgttacctgtgatatgtgatcttccttttcattttaatgggcacattgttgccactcagttctgaaatagagaatttctccatcttccacttcgttaactttgcacaatatattgaagaatatttaaaatactaaaactccaggtgactgtagacacctaccatataagaaagtgggaatgtcaaaataatgagatatccatgaagtgataatgtaagctctcttaggtttatttccttttttaaaaaagttgaatttagaccagagaaagcttgaacctgataaccaaattagcacacactgtagtcacaaataaaattctgaggaggtgttttggagttgaatttaaggggaattttaataaaaactgtctttatttcagtccagcaaagtagctttatgcaagcataagtgcctgaggagaaaaattatacaaagtataagagataaatagatacaaagttgatgtaatttctacttgcaatgtgtaacagggattatagtgtgccaaaattatggtgtcatagtgaatatatttagcataacttttataatatttgttcactctagaaaattaaggcaatactgaaaagtacaaataaaacaataaattgcctataaaaccattgcttgaatatagcttcattaacattttgatctatattattttagttatttttcctgaatttatttatttttttttttgagacgtttcactcttgttccccaggctggagtgcagtggcatgatctcggctcactgcaaacttcgcctcctgggttcaagcgattctcctgcctcagcctcccaagtatctgggattacaagcatgtgccaccatgcccagctaattttgtatttttaatagagacggggtttctccgtgttggtcaggctggtcttgaactcccgacctcaggtgatcagcccgccttgtcctcccaaagtgctgggattacaggcatgagccaccgcgcctggcctatttttcctgactttaaaaagtgcatgttagggccgggcgcggtggctcacgcctgtaatcccagcactttgggaagccgaggtgggcggattacaagatcaggagatcgagaccatcctggctaacatggtgaaaccccgtctctactaaaaatacaaaaaaattagcctggcatggtggcgggcgcctgtagtcccagctactcgggaggctgaggcaggagaatggcgtgaacccgggaggcggagcttgcagtgagccgtgacctcgccattgcactccagcctgggcgagagagcgagactccgtctcaagaaaaaaaaaaaaaagtgcgtgttagatgccaagcacagcagttggagtacggagaccacagaggagagtagtgcctggctctgttttcactgagcacacagcctgtcctacagacaccgcgtaattgttttatttctctggagttgaggcagtcctatttggccctttatgtgaatatttctagtcctcttaacagccatgcaagatgataggtattgttctttcattttacaaataaggaaacaagtgttcaaagaggttagatattatacccagagttctgtgtccagtcagcagcaaggttgttggacttcaaaacctgcaattctccctgcagcctcagactatcactaaaggggtctcatcataattgtggagtcattcagtgagtgttggagaagagcagtgcacaacatggtagacgtttagagatcgagtggaggacgttcactgcagtgtgggcgttagggaagtgtggagggtgtcagacagaaggggacggtacaggcaaggcttctggggtaggaaaagtgcctggtgggctccggcagctggtactgtttggccatagtgggggacttgaagggagaagtgggagaggaacccgacgaggaatggagaaaagctgggcagagctcatagagtcttgaacatcaggctgaagaatcgggaccagatggaccaggctgccctgggactgacttatggtttagaaagatttaaaagagattttggagatgttgaaatgtactgagtccatagactgtttttaatggtgtgtgtgtctgtgtgtgtgtgtgtgtgtgtgtgtgtgtgtgtgtgtgattatttgggtaaattgatggtttggggactaggggttgaggatgctgtatttatattgcacatgtgctccatgcactgatacccttcttcaatgaaaaaggtcatctgaaataaatatggccagaaatagtgggtttatatcatgtcctggcttgggaaacattatctctagagaagaactatttgaatgagggaaattaatataaacaagaccagataagcttgttacacgataattccaaatggatggcaggtagctgactagggaactttacatatctatggtatcttgaagttgcagatttacttgcatatccaaggggcatttgacatacagagggagaaagagttggaaactattgtcagcctctttcctcacttccattttacttccttttgatagatgtgcatgtctttcctttcctttgatgaaaaagataccactgatgctttcttcccttgcttttccattgtttcattgtttcataaccctcctctcccttcttgattttcaattcttttgtgcatgcatatttctaaatgctcagtaaccttcctcctcttggccaagagcccaggcagatattatcagactcctgtccttggccaagagcctgctgggaaccagtgaatttcttgtcagtttctccttgccctccatgtatgtattgccttctgcttggcaaatcctgacctgaagggaatagccaatgccttactagacactttggatctcaatatatgtttcctgaatgagtttattactcatgtgagtagagaatcctttcacggcaggaattctctttaggtacccgtgaatctaaagatatatatgcatatatatccacatacacaacacacacacacacacacacacacacacacacacacatatatatttttcttttgatatagacctggttgatgcctgactcattatagattttgattatattaaatttttgaatgctttgtgcagaaagcatttattaaagatacagggaacttttggcttatgggccaaataggggttgtagttcaattctatctatccctgagaagtattaagagatgtcactgttctaaaaatgttgctaagatttttgaaaacattgaacaacagtgcccacaagatggggatattattccatgggaaaaaaaaatatatttttttcttagtaaaattggggcagtgtaggttcccctacttcccagagtgggaagatatttttactccctttagattaaaaaaaatgagtttataaaatgaaaatgtattataatttgtaagtgcttcaatattgtgaaacaatattgactgattacttttctcattccatataagactttgaatttttttttaacaaaggagtatttgtagatgaattagacatttgaccctctgtataaaaaatctatgcttcatcccagatttaaaggaagtgctattaagcatcaacaaagaataggaaatagcttttaacaggtacaggagaaaagaatggtgttcccaatcaactaagacttgtaaccttatttgtgggatgagatatacacagaaatgtttagtaaaccaggatgtggtatttacaactgtatatacacttgtttttgatctctacttctaagaagcattggtgtctgtatgtgcaggtatagtcaggatgtaaatcagtttataataggatactttgcaagagaagtagctggggaagggtggaggcaggccctggagtcaggttgaaggcatcccagagtgggggcctccaggatgtggctgaacggtgtggagagggccaggggcattcttggtgacggaagtagcatgagcaactagtaggtgctccaaaggtggtttgatgaggatactgtataccattggccctgtgaataagaacccacagaaacagagggccaactcagtgacttgagcatccacagggcttggtatccacagggagccctgaagccaatccccattatatggagggaggaggactgtattgcattagtggtgtggctagacacttgccgttcttttggctgcccagcatctgagcgctcattctggtgtggggagttctctactttcggagctttgctgggaggcagaataaccctcttttccacagaaaaagagggcagtgtcaattgctacaggcattgctggtgtgagcatcatcatctgctgctccctggtgctcctggatcagtccatggcgtgatctgaggcattattcctggcttttggacattctgggagccacctagtaagcttttaataaaattctcttctgcttggtttcatcagagttaatttttttctattttaatttatatttttaatgtatttattttgccagtagactagcagcaggcaaagatatcagagttgatttctgtagcttgtaattaaaagtcctgatagaaagagatgcacatcattgagcactttcctctgtgccaagaaaattgcatgtgttttatgtacgtatctcattcaagtttctcctgaactctgaaaagaggtaacattattggtctctcattcacaggtgaaaaaaccgaggttcagagaggttaagcaatttaatcaaggtcatgcaggcagcaaacaaagctgggatatgatccaggcttttctgatagggagactgtgatcttaacctcttctgctctgctctatgttgttattaactacctgtttgtattttagagcattttattatgaaaggttctttcgcagaacatagtggaggcaagacttggctctcttacttgattattttttatttatttatttatttttttggagacaggatctggctctattgcccaggctggagggcagtggcacgatcttggctcattgcaaccactgcctcctgggctcaagccatcctcccacctcagcctcctgagtagctgtgactacaggcatgcaccaccacacctggctaatttttttttgtatttttagtagagatggggtttcatcatgttacccatgctggtctcgaacttgtgagctcaaagcgatctacccgcctcaggctcccaaagtgctgggattacaggcgtgagccactgcaccagcctttttacttgattattaaaaataggatttgacagatgtagattgtcattggttagaatgtggaattaaacccttgttctactttgctgtattgtgtttggggctgatgtaaaggcagagagtagatcctaaagacaaacaggcatagaagagggaaagtggggaatgaagaggtgggaggaaaggaacttatcacacttctaaaaagtgctaaaggctctgtcagagttctgcttctcacatcatcaaattttcaataataactattcacctagaacagtctatacccggatatctgcatggctgaaactccctgcccgctatccccttcccccatttcattcaggtctctgctcaagtgtcatcagagaggtcttctcttccatctataataaactgctccctgctacccacccatcctcttaacccacctaatttattttcatagcacttctcaccacctgactggttatacatctttgtgtttactttttgtctccttgccactagaatgtgtaagtttcatcagaccacggactgttttgttcactactaaatccccagcatttagagtgtatctgatacatagtagatgctcaaattcatttacttcaatcttgagtaaatgaatgaaggtgaggaaactgaggctctgagagttttagataacttgcctttgatctcatggaaaatgatgaaaccaagttgcaaattctagtctaggtgactcctaagacaccacatttctcaggttccactctttactaacatctctattcctgggaaaattcctctatttgtacacaatttgggtaagaaacatctcatgggatttcaaagttgaaaaaaaaaaaccttaagtagccagtctaactttcctattttacaaatgaggaaataaccatgatccattgagggtaggtgacttgatcaaagtaatactgctatttactgataaaggaaggaccacaatcaacctacctggtcatcagttcagtcctatctccccatcccctgctatgtttattgctgtcttgataaagcaagccctatttggtgcagaattcagatgccaatcattggtgatgggttcgagataatgagtcatgccattttaatcccataatattaacgcagtaaagcagaggctgcaaacccagaggcccacagggacccatagatagcatagctttcagatgggattggtgggggctgtgccaaactgggaggtagataacctgttcaaaggggccagccccaccacacctgctgcctgctcagagaaacatgttacaagaaaaaaacatggtaaaccaatttaaaaatgtttgaaacaccctgctggccaaacaaaacacttctggctgccaggtcaccctggtggacttcagtttgcgattgctaaaatcttagtatgaacagctctttccaaaggagatttcagtacgtgtggatatggtggagaatatgtgaagtgctatcattgtggctaattgttctttagccaaaagattagtgggttggactgtcaaagttcacagagtgaaaataattaacaataaaagagtatttattgcctgtctttattaccctggtgataaagttgaagagtaatgtgtttcctctgtcacgatacaatctgtcctaatggaggatacttggttatgctgtttcctgactgggagtcaggagacctttttagatgtttggtgcagctattaactacctggatgttactgggcaaagcacccaatttttctgttctgccatattcacatttgagtaattaaggactggacttaattattggggcgtaggaaacaggatgcagaggattttataccagacttgaaccttgttttttatcttcatctctagaaaaaaagaaaaagcctgtgttgtcagagcaagatagggactggatcattcgtatctatcacatatgtctttgagcacattgataatcacagtgtatttgctgctcttcttcagatgagtcagctgtgaagcttagataggttgagaatgactggacttagtgatctctagggtcgtttcagctctaaaccctgtcacagcttgtgttacccttgctggggacagatttcagaggcatttatcatacagagtcttgagcatgggttttgtggccacatggcctgggttgcatcttcaccttcctggcgatgttgattttctctaagcctcagtttcctcatccttaaaatggggggttataatgacaactgcctggtagtctcgttattgtgataattgcccctgacaaattattaaatttaattcttacagtgaagcaactgggcagcataaataataaaattttaattaacatttacatttcaaatgcatgataattctctttttctggcagattttaggcttttaagtttcttattaggaattgagatgtgttggaattaagaggtggcaggcttaatcagtactgttcctcacttacacattcagtttagcctaatgtgcctctctatatttaagcagtaccaattaattaaggcatagagagcagtgaatcttgtatcaatgtgagctgtaggtaccctgattttaaccaaacagctaactttgcctgtggctacaaggtcatgcttgtgaatccttgcacagtgaaacagaaagaaggcttcacatgggcattcagtatcactcgaaggaggccatctgactacaactttgctgtagagggaagcatgtattacaggagaagaactgctttagtagtgttcacgggctaatgtgaaggacttctgcactagaagaacaaaaacacctctccagatccatagtggagcataatttaaggcaagaggatgacaatagacaaattgcacccacttcaaaaggagagagtgtgtttacactgagtatttgttccaaggagctgagaagcaggcaccatgccctgatgggcccttcacactgggttgctgtcactgctgaaagagcagcctgtccttgtctgctgtactttcatcttctgccatatttgtattcatgtgcgctatcctcccacataaaagagcacagcttgctattcctgcctttgcttctgtgacctgcagtaaaaccattaaagatatattttaaggctttttacatggaatggtaattatgcacaatggtttttaatcatttggcatctagcatggagccttcagagagtattatgcctcagagagctgcagcttgcgtggatcttgggaggggcccttggtttcaggggctttgtgttctgtgtgtgtgtgtgtgtgtggcaacaccaggtagtgacaacagtgtcacctgggaaacagaggacacagatgactgcttggtggacttgaaaccagctctaaacagctgttgggttctgaacaaaactccaggaaaattgttcgctgggtgagctggtgggatgaagagactgggatgggctgagggtggagggccgaacggataccctgcacgttatttgtggtgttgtcaagggagagtttagagacatcacatgaatctcaccttgctgccaatttggttcatagaaagtcacagctggaaatcttcttagaagagaacatcttgttctcaagcccctcattatacagcggaggagactgtggcatgcagaggtgaaatgacttgcctgaagtcagttagctgcttggtaaaactagccaagaatccaggccttctgattcccccaccccagcaaatagtgtcttttttttttttttcatttaaagagaaaaagggtggatatttattaaatagggggaaagaaacagtaaagtagaatgaacaaagtataatcctattatcaaggcaaaccactgttaatatttttatattcatcatcccatatattaacttttttacaaattattattaaacaaattatccatattttgtatcccactttttttttttttttttttttaagattcttgcacaggctggacttgaactcctaggctcatgcaatcttcctgcgtcagcttccccagaagctaggactacaggtgtgtgccaccacacctggctgcttccacttcttttttatagtttccatttatttctgcttccactcgtatcaaatttttgttgcctagcatccctgactattaaggaacattaatacgagtttgtcttaatcataaaaagaagttctttatagctttaatgttaattcaccattgtgattcttttggtttttttttttttttttaaaggttttgtgtcctctttttctcctcctcctcttccttttcttcttggttccgtttttaatgtacttaacaagaaagtcattgtagacctttatgatgattctttatttcaattccaaacatgcatactccctcacaccacacacagattctttcatcctaaatttgttttcgttgagctctttcactcctatcattttaaccctcatggatatgctaattattccaaaattatctccagccagtaactctttcatgggcacaacctagacttccagatgtctagatcagttcttgtctattttgactgtgcacaggcgtcaccttgggattttgttaaaatgcagatttgaatccaacaaatctggagtggggcctaagattctgcctttttggcaagcttgatgcctggtgccgctggtccgtggagcacatttaggtagcaagggtctccaacatacctcagattcagcaggtccaaactgagggtgtcacattctctgccaaacctgctcttttttttcctatcttcactttctcagttaatgactttgccatctaccctcctgtccaagaacaaactgtggaatcatctttgtttcttctgtttccttcatctactttatctaattggtcacccaggcattctctttgggaaaagcttcttgaatgtgtcctttcacttttgtttctaccaatgccctttggattcaggaccttatcatcgctcagcgatctgtttacgccacagcatcttggccccaggctgtctcaggatgtgccttctcagaattatctttctaaaacaggaatttgatagtgacatttgcttgtttaaaaactttccattgtcgtactgcctgcattccagggttcttaatttgacaagcaaggtcctgcaggatttggcggcagccttattccctccaaccccaaccccctatctggtgccttctccctcccccagggggttgtacctccctgaaaatgaatgcagtctgtctacatcaccgcactcacggttctctaaacccactgtccatgcttgctactctgtctttgcttgtgtggttgccatgccttgaaggcctttctcatcacgttctacctggtagactcctactcaacctccggctcatgtcactcttctgtggagccttcaacggatcccttcactagagcttgtgacttccctaatatgtgcttccatagcacttaccacttaggatatggagttgcacatgtctttgttgccttctaaattctaggcccaggccgggcatggtggctcacacctataatcccagtactttgggagaccaagagttcaagaccagcctggccgacatgccgaaaccccatctctactaaaaatacaaaaaagattagctagggtgtggtggcgagtgcctgtaatcctggctactacagaggctgaggcaggagaatcacttgaacccaggaggtggaggttgaagtaagccgagattgtgtcattgcactccagcctgggtgacagtgagactctgcctcaaaataaaaaataaaataaaataaaataaaaaaaattctaggcctatcttgtctgaagtacacctgcgttccacagtttggcatagtgtggaataaagtaggttttctctgaatatttgctgagtcaatgagaaaataaatgttttgtagataaacaggcattaacttgtacatgttagcagtgagaaggaatgacagcaattgtctctgctgggctctacgaggagaacctgcctactgcctcattcattctaaagctaccctgtcaagacagtagtcatcagcaacctgtggtcattgaacacttggactgtctgctccaaatttagttatgatggaagtgcaaattatgtgcaggatttcaaagacatagaatggaataaaaaggatttcattaataattgccatatttattacatgttgcagtgatgatatttggtgtatattgcgtgggttaaaattaacattaatttgatctgcttttcacttttgtaaatgtagttactaaaaaaaaattaaataactttcgtcctcaccttttatttctattggccagcactgttctaaaatatcaatttatttctcatatttgaagcacctccggaaggtttcccattacccccacaattgtgctttttaagattccataaagtgatgtttagttgttttcaattcttatgagttactgactttaaatttgtttcagtgaagactctaccagtgaactcagttcaagttgtgtttttgagatgattctcttgattcttactgaatcaccaaactgaagaactttatcatatgtcagatgttactgttacctataaatagaaaactcaaaatatattgtttttctttttaccatgacctaggggattagaaatggaaagtgaaaaattttagcgtaagatttgtctgcatcctcaaccctgatgtccacacagtttctcactaattttgctgatttaaaattatacacattgcatgccatcattgataccttctgcttaatcagtttttcagtgtttaaagcttaaggattctatcacttttatgttttttttttttccatttgaggtgcctaaggcaattttattttaatttttttgtaatcataaaattcttttccagtgcatccttaaacagatctccaaataacaaaatcaagacaaagattctgtggttgaggtgtaagttgggacccagagaggtccttgcttgccacttccaaggcaaagtggcaggtgaaattatggctttataggtgaaaaatcactactaacaagttagtgctatatgattttttagaaggagaagagacaagatattgtcattccttttgtaggatgtttcttgtaggatgtatcagccatgctcacacggtgaacagtagacctgaagatatgccaccttctctcttccagtagtagttccttcccacactatacagtgataatggtgtaagaaacactttttctggaaacattagtatgggctaaaaatgatgacaacacttcaggtgggaataagaacctattggagataagatgagtgaccgtatactatgattcatggagcaatagcccaaagtaaggattaggtgaatgcttaggaggcagctaataaatgtcggtctcttttctgtcatgcatactccatcgcttattgcaattcactgattagggtttaaaatggcataatgaattatgcaaaaactgtttctgcaggagggtctgtgttgcagcctaatgcagcacagatggaaagatcctcttttaatcattgttctcacagtacttggaagctttttgaggaataagcactcagaagtggaagtgaatggccttccacagtaaatgaattccttctgcagagaggaactgaaatgtattttgcgatgcagatggttgccctgtgtttgaatactcatccttgtcatttgggattcatgcttagaagcaaaatgtctcttgaaatacttgagtttagatgattccattggagaaattgctcctgtccagtctggcccaacatgtattaagttgttttttttttttttttaatttcaaaaatggtgacaatgagtgtgtaaaatgccagctcactccaattaagaaaacatgcaaattacctctctttgatcagtagttactactgaagagactaaactagttactatccccttttattagcataatattaatgcaaatgatcagcaaagcctttcttaaaaagaaacaagaaccatggaaagcaattaataacagtgctaatttcctcaggaagcaaaaaacatttatgattaggcttttaactttggtatctgtgccaaggacttcccacctgggcctaaatatgtacctgtttataaaattaatgtcaacttggagctttcatttgcagagtaagagccaatctgaaaaaggcccaatggaaaaatttcagaacaaagatgatatgctattatctgtaggtacttcatgatttggatgtcaataagaatgtgtacttcaggttgtatttataagacattgctttttaaaatacaggggaaaaaagtaaaggagtaaaactcattggccaactcaaggtatgataaaggactgccttaaacttttcccaggaggggattaatataaagaggacactgattacttctttatttgctcagaggaaatgggcttaagttagagggaaataaaattgaatcaaacaagacactgttggctctgggagagctttattaaattaaaatgaggcatagcaaaagactggaatctcccttctcacctcctcttactgtgctattgatatttttttttattttttattttttattatttttttgagacggaatctcgctttgtcgcccaggctggagtgcagtggtgcgatctcggctcactgcaacctccgcctcccgggttcttcaagcgattcttctgcctcagcttcccaagtagctgggattataggcgcgtaccaccatgcccagctaacttttgtatttttagtagagacggggtttcaccatattggcctagctggtcttgaactcctgacctcgtgatccaccgcctgggcctcccaaagtgctgggattacaggcatgagccaccgcacctggcctactgtgctactgacatttttaagcactttttggcatcttgtccttgcctatgtttaactagcagtgagcactgcaacacctgttgtttgtcccactcatatggtgtgaagccaggctgccctgtattactgtttccctacatattttatctcctctatcaaaatgtagattcagagatcagtggtaaagccctgtgcttctttggacttcaaacatcagcatgtatagttgccttgcaattaatagggagtcagtagttgttgaatgaatgtgtgaatcacagctttagtgatctgtttattattaacaagcaagaactcaagttctatagtatcactccatcaaaacattgaatcattgacttcattccagtttcactgtttttttcagtgtctcctgtgttacttgaaatggaaaatgtatattatgtgggtgaagttctttttaaaaccataactgcaatgatttttataataaaacctaagtgcataattctgattaatatctgtaatgagagaagaccaatgaataaatgtaggcattgtccagtaaaactgtattcataaaactattgcattaagaaattagcatttctctattagattggttggcgtatgaaagtttgtttagagtttaacaatatttgtcttataaaaactgcattttactttacggaactggcttttgcaaataactgaagtcattcatgaggtaagagcctttaacaattggccctcaaacacctgagttaaaaaaaaaagaacaagaaaaagttctaagtctttgatctttaccttagagtatctgacaaccttgatctttctgtagacttattctggcaagatggtaaaggaagttctatttttgatgctgtcatctacactggcttccatggctgtgatacagcataaatactgacttctgccctggaggatattacatgctcttaatcctttcatcatcttttataactttatggtctctacaggctctgttttcttttcttttcttttcttttcttttttttttttttttttttttttgagagagttttgctcttgtcacccaggctggagtgcaatggcatgatctcagctcaccgcaacctccatctcccaggttcaagcaattctcctgcctcagcctcccgagtagctgggattacaggcatgcaccaccacacctggctaattttgtattttagtagagatggggtttctccatgttggtcaggctggtctcgaactcctgagctcaggtgatctgcccgccttggcctcccaaagtgctgggcttacaggcgtgagccaccgcacccggccgagcctctcctttccgttcaatagctcattaactaatctcttctgaagtgatggatttctgacacaacagttctttcttccacctctctttcctgacaagcaggggcatgggtagctcagacctctgctgaggttcagtcgaggtcctgggagccttggccggtgcagaatttagggctcaggaaagtgatgtagcagacagcattttggggagaagtagaaatcagtcaacttggatcatttctttataggaactgggcagagaggaggatccaggtgtgtagcgatgggaaaagtagaggagaaccagagggatggaaatggaagactagaggcggaagtccttgaatgggacactgatacagaatcagctttctatagagtgccaagacagcgttggctgtagctagcggggcaacgcttgaggccatgaactacttacgctcttcttcagctgtttcagatccccacagggaatgacattttggaacctgatgccatattgcttttggttaagtgggaattttgctactccatgtgaaaaataggtaagcagtaggctagtgtaagcctggtaatgagcccgagactaagggttggaaagtagagatatttcttaaggatcaggacagaaattaagctaggacagggtcataaacttccagcttctggggtttaatccgcctagaatttgatgtgtctgtgggtggcatttgctggagctcagtatgcccatattgtgctagatgatgtggcattgcacaagaatggcattaactgtgtttccttattaaaagtgtttttctctaccgtctacctctcctcccctcacctttttcaggttcccacaatcccttcctgtaaaacctttgtccgtccctcatattcatgttaggcctcactgccctatgagctctgttcctatcctctaaacaaagctcagtggcttttactgaaaatgcttgtttttgtgaggtgtgtgtgtgtatgtttttccagacagggtctcgctctgtcacccaggctgaagggctgtgatatgatcatagctcactgtagccttgaagttctgggctcaagggatcctctcacctcagcctcctgagtagctgggactacagtcacatgccactgtgcctggctaattgttttattttttgtagagacaatgtctcactatgttgcccaggctggtgagtcggattttttttttttcttcaaatgttaaggttaaattccctgccctaacccacaagtagctttttgcatgtggaaattgtctttagttcttgttttatatttcatgtatcttttaggctgcttgcattcacatctgtcatgggctcagcatttcaaacatgctaagaaaaaagtggctttagataatctcacttaagaaagattgttttgtagtagtattcacatattctactttgttactgactgctgaagacatttagtagaaaacataaatgaattgtttctaagcttggctaaattatttgcttggctggaagttatttctccatcctctctgtccccctagtagagctgacttttagtaccttgcatataaaaacacttcccggccttctatacttaccagtggagcattgtaatgtttgaagttgattttgagctactcataaaattacagttatagcataaaggaagcagttttcttttttcctatctaggtatttaccacggaagtgctgctgtttttaattgttctattactatttaccaacattactttataaatatcttctccatttatattttctaacataaacacaaatctcctttcacttttaatattttcatccagtgtttgtctgtgttttttcttttgctggctggtggaatgttggttttatactcccctactctcattgagatatgagatgatttctctaccttattgcagtggataatcacaaagaactgagaagagtttaataataatgcccatgtctctttcataatatggtgtgtatgtagctttcgttattatcagatttttttttaaattcaccattgccttgtgttgatgtttttattagcatagaaagttatatgaaagtcctactgaagggcaatatatttgctataggaaataaggaaaaccacgattatattcagtactattctaacattaaatttcaaaacattgtttataattttgtgttatgtcaacaagtattttgttagtgcttatttcatgacaggtattatgaatcaatagcaactttttatgaactgaagggatatcagagcattataatttataaatctgtagtgagtcagcagccagaatgaaattcctggatgatatttaaatacttttcttggatcccagatcttgaagcatattaagtcttatatgtgagggaatttgtatcttggcgtaaatttatctgtattgcatgtttaaggtgtgttggcaaactgtagtgatgagattctgaactaatagaaattatgatgggggaattttgaatgaccagttcaagaatatgaggggaggtggaaaaacctttaatcttcactagtgaatctttcttcatttcatccctgaaaatgtcttcaggacttgatagatttctcagaaaggaaacaggagcacagctttgaaactgaaaaggtgaagaatttgatttggcgagaacaataaaaatgaatgggtaaaggttgacaaaaatttagatgtgatcactacctctgaagctacatgattgctgtgaaacaagaactgagtactagacagttgttctgaggaagctggcctccatcttgggaaagaacaactttaataatggactgcgagggggcttcaggcaaaccctggagaacttcagaaacagaccaggggaggggcagggatgccaggaagggtgtctcagtctgtctgtgctgttgtaacaaaatgccatcaactaggtggcctataaacaacagaaatgtatttctcacagtttcagaaactggaaagttcaagatcaaagggctggtggattgggtgtctggaagggctggctttctcacggatggcaccttctcaccatgtccttcacattgtggaagaggcgaggctgccatctggggcctcctttataagagcatgaatcccctccctaagggttccatttttctaatagcatctccttgagagttaggatttcagtatatgaatttggtggggaataagtagcatttaggccagagcaaggagctatagatgttaacctcaaattattggtctaaatctcaggaattaattgagcaggggatgactggagaacgagtggataacagtggcagagaggagatgaaattcttactgaagaaggaatggtgaaccaccgcagggcctgaggagtgttagggacaatcctgaagtaaaggccatgacctggaggcctatgctggaaagagttgtctgggccactagttcagtgaggaactggaaaattccacccatcactggtgctggtgtcttttgtcatctacctcacactaaatgtttgaagagcttggttaaagcaacatctgtgataaggcacccaaccagagagtaaggcattcagtaaatatttatttgttttaaagattaaagtgatgaatggaattatggaatgtgtgcttaaaaaaactctgagccgaaacttgtttgtaatttaatattagttacaatctcatatgcaaccacagcccttccttttgtatgtttctgtttcctttaggaaacctacttgtagactaaacatccacaagtaacatcatggagacatagaacatttaccttattaattttagagtttcctaatgactgatttctttactatctgcttttcatccctctcttacttctttgtagttttgtgcaattaaataagaaatgccttagaaattattttagaggcagtagtactttaataattgaacagttcaccaacatctgctatggcagtttgctcgaagccagggatactaagaggaaaaaaaagaaaaaagaaacatagattcttgcccccaaggaacacataatttaatggtggggacacacgcacaagcagatcatcacagcgtaggatgtggtaaggaatgcggggaggctgcagaagcaagcttattccagccccacagagaaaggtactgagatatgaaattgagtaatgacagctggaaaacagatcaaactggagagcctatgctccaagtgcaaggtagctactggtgtttaatttccaggtggctctacagctgggcagaacaagaaaaagatagagggtcctggagaaagaacatcaggtccagggtatcaggtggatgcaagtcatggtgacagataatagaatgaagtggatatgctttgaactaatgttccaagatcctgagatttttatgtcaaagtcccactacagataccttcatccttgtcttggaagatgattttgacattaaaatcctaggttcccatttggctacttgttgagttgtatctccaatggaggaggaaaaactgcttcctgagagatttggcaagctcaggaacaaagaagatctcacttctacccagaaccagagctctaaagcaagaaacctatgtctggccagtgatagtctactattttcccgtatatgttccttgtgtctgtatctaaaaaggaagtgaatttttgaaacctgcctcggctgtctcctgcctttcccatattcgtttcgttctaggccttccctcccttttttctacaagacctggtggtggttactatgtccctattcttttagtgatgtcaagaagtagagtgaggcaaggtgcagtgactcacgcctgtgatctcagcactttgggaggcctaggtgggcagatcacctgaggtcgggagttcgagaccagcctgaccaacatggagaaaccctgtctctactaaaaatacaaaaaaaaaaaaaaaattagccaggtgtggtggcacatgtgtgtaatcccagctactcgggagactgaggcaggagaataacttgaacccgggaggtggaggttgtggtgagccgagatcacgccattgcactacagcctggacaacaagagtggaactccgtctccaaaaaaaaaaaaaacaaaaaaaaagaagacgaagtagagtgaaagccgcaacgataaataacaaacaaaaaacccagcacctatgaattggttgtgtcatatatttctctagaagtgataaagccaagtttccaaagctagttcttaacagtgtcattaatgggcttgtcttctcagttttgcttaggtaatgtgacataaacaggataatcaggtcatttgcttattgttctgctgaggattttttttttttcttttctacccactgtcaaaagtgagtagcaaaaaacaaagcaagaagtgggtgaacactgaaaaactataaagcactatacaagatgttaagtgactttttttttttttttttttttttttggagacagagacttgctctgttgccaggctggagtgcagtggcatgatcttggctcactgcaacctctgcctcccgggttccagcaattctcctgcctcagcctccagagtagctgggactacaggcgtgcgccactacacccagctaatttttgtatttttaatagagacgaggtttcgccctgttggccaggctgatctcaatctcctgacctcgtgatttgcccgcctcggcctcccgaagtgctgggattacaggcgtgagtcaccgcacctggccgcgacttttatttttaaagaaaaggaaagctgaaagaaataagtaaatttcatttttttcccaaaatgaaaagggtaagatatgcaaagaggaaaagaagtaagtttctgtgaaattcagtacatccttaagactatagcatttgagtcagatagaagagattagattctttctctgggttctgatggttgcatgggtgtgtgtggggcgagtgatgtggtattgctttctaatcaacttcttactgccttcaggcattatcagtgttctttcttcctggatgtcagagccacttctaataatgactgctttcagctaaacaacagtaggcattctcttcgaaggggtaaaaatgacttgggtcatttgtaggctgcagctcttcatagtcattcaaattcagcatattctgatggacaaggccattacacagtattaatagctttaccatctcaccatgatagtgattacagtagttctttaatatcgctgctgaaatgaaagagataaatctacacatgagaaacatgctttttttttctaacatagagataatgtaaagacacagtattaaattttaaaatttcaaaatttacaaaacaaagtttcttaaaaaacagaatatttaaagttatgcccagcatgacacaattttttttttttaaatagagatgtgtgtcttattagttgcccaggctggtcttgaacttctgggctcaagcactcttcccacctcagcctcccaaagtggtgggattacaagtgtaagccactgtgcctggccacaaaccatattttagaaagtgcactggacaggcacagtggcttacacctgtaatcccaacactttgggaggctaagacaggaggattgcctgaggccaggagttccagaccagccttggcaatacaaggagactctgtctctacaaaaagttagccaggtgaagtggtgtgtgcctgtagtcccacctactcagggaggctaagttgggaggatcgcttgagcccaggagcttgaggctgcagtgagctatgattgtggactgcacttcagcctgggagacacagcgagaccccatctcaaaaaaccaaaaaaattgaaaaattaaaaaaaaaagtgcattggaaaagaattctcatcctttttaaaaaaatatggtttgatttttaaatgtatttttttcttgataaatgtaatggtcatttgaaagtgcaaattatagactgtgtcaacaagattacttttgccttggctatacgcaatacaaactcagaaagattgatgcatctggggaaaacaaagtaaatcctatcctttttagtctgtttgacatattaaagtgaccactgaagaagaaatgagggcattaatctcgattctatcacccctttgctgggtaaaattggggaagatttaaccttgaggcctcattatctcatctagaaaataatgggataggtttaaatctctgaggtgcaatagcattctaatgtttacacttcaatacatatggcttcttctaaaatattcttagtcattatggtttatatgtcatgatctgaggaagaacccccaccccactgccttttttttttttacacattaaaacagaacgaagccaaaacaaaaataaattttattcttctgtcttatactgtatgtatatcccaactcagtcacttcttgtcctgcatggaaataaaagtgggatagggaacatgaaagaaagtatatcgtttttagaaaggatcttataagaaaacaaaacaaaacaggtgctaggatcagaggtcttcaagaaagctgactttggggcacaaaaatgcctcgaagggtcagaagcaggagacagactggatagaaagcatcacgataggactttaaacagggtagggaacacaaggtagaaattggaccagatagttaaatatatgaactcagaagaaacatcctacttacaaataaatctgccctgaaggagttttaggtagagggtagggatgacaaaggcacattaaggcaattttcaaatatactggccaaaaggggatgcccagagagaacttctgccccttacacataatggacaccagcaaatgattaacagtattggcaagggaggggttttttttaaagacattttaattctttgtcattatagtataaattaaatatggatatattggaataagtcccagtttttgtgaaaagatacagaactaaacaaaaacaaagaaataagtccagtcactaggaaagcaagtctgtttctctcagagggctttctggagttttgcccatagaattgaaacgtgcattttcagacccattatgtgttgtttttgagaattcttaaaacagtggttttcaaagcgtggtctgggaacacctgaggctctccagaccctttcaggtgtctaggagagtaaaactgttttcataataacgctaagatgttatttgcctctttcactctcactctctcatgagaatacagtggagtttcccagagacgacatgaactgtaatattgtaaaagattgaacgcagaagcagatgtaagaatccagatgtcttctattaagcttgacattaaaggcagtttcaaaaatataaaacagtgctactcatctcactatttttatttgaaaaatggcctttttaatgttatctatgtgaagatgtttattcttaagtgaatagcatttaaaatattttgtttctgcgtttaatattataaatatcagtagatatcgcctacataagccaaagctctttgagggtcttagaacaatcttaagtgtgtaaaggagtcctgagaccacaaagcttgagaatattctagaggatatgtgattcctctagaccttattaaacagtgggaggggcagttagtacagcacaaatttacctaggggacctttttcatggttacctatgaggcacttcagtaagaattttcacaacaaacaaagcaagcaaggccattgttattcttcccattttttagataggaaaagtgaggagtagagaaagtgagtgatttaccaaagattgcagttaagtagagctggaatcatttggtacttagactcccagttccatatgtttccatttcattttgctgactgagctgactgcattgatagcagaataaatcatcaatcttctagctgacctcagtataatcaatggcaacccccacctctttgtaaagaaaaaatgtcagaccagtttaatatttgctatgacaaaataaataacaggcattattactcataccctgaatgatatcagtgcctttgaaattcactgaccaggtggaaaatgtatcacgggaaaatgggatagcatataccttgggaaaatacaacaaaacaaagccctcatttttgtaaacagagcatggaggacatgctagcaagatggaaaagaagattccaggaaggcccatcaggatctgtaaagtgaatatttgcttgtgatgtgagtgttcatggtaaaaaaaggcaaaatgattatactctggtgtattggaaagagcgtgacttgtacagcaagctaggaagcgattctttatagagcaactctggcaacttcctttagaggacagcgtctagttctgtcattatacttgtaaaaggtgagaaatgcgggagcttctgaagcatatccatggcacgattagcacacagaattctggagggagagggaggaggaaggaacttggaataattgcttgctagaaagtcagggaggggtcactggtagttgcctgtggtataaactgtgtgtttctttgatttcaacaccatgtgtcaacttggatcttttggaaatataaaatatttctgctctgtacttcattacatctagcagatgttgctttatgtttttgaaccccatttgcagaatgaacatgatatcatataacatactcctaaaaacagaaaagaggaaactagttaactggcctcttagcagaacagttttaggaaggtccagacttttagtcactgcctgtctgaagtacaaaagtagaatatattctacaaagaaaagaagtaacacaacatgttcattgatgtaaactgaaggaatgttcacttacatttttagacaaattaaaaaatacgtggcaggttgaccaaggagggtagtctattactgaatggctgtctccttcccactcctcatcccctcttatttaaaaatgaaaatgtgttcttgcagtatttaccagtgatcaaaaaaaaatacagacaaaagaaaaagaaaattcctcttttccatgactcagtatttttaggttatcacaaacctattcagcttctgaatcttattaaagtcaaaatattgagtcaattcatcagcactaagctattcaatttttgctttatgcatgttttgaaagcaaggcttgatatagatggtgtatttatgtaacaatggtgttactcaatgaccttgcatttttctgcacatgctatcttaatggaaatttactggaaaattcttgccagaataaacacattccttcaggagtgaaaggcttaatgtacttctagttcaactgcacctttttcccttgagcagataaacccaattatttggcgttagtcattatacttcacacagtttacagtacttattgtggtctcacaggggggtaagagttaaaggagacagaagtaaggtggtcaatttcacactatgagagagaaaacaaaaggataaggcatctgtctatttgacatgcaatacgaaaaatgaagctggcagtcatctgtaaattaacattagctatcctggtaaggcagaagtaaggaatatgaacaatacagataagttgagctgctgaaccagaaatttaaaaatatatattttttatttttaagagagggatgactttctcatttacatgttaatttaagaatcaggagtgaaaactctacaagaaaaatactggctatgtagtggccattggggccggatatggggacccaggtggaatacagagatgtaaacaggacgattgaggccagggaaggaggaagtaccccttgaattaagggatgaagaaggcaaacaatgaacaatggagacttaaggaaagagattcacaaacatgtctagacttaggcttgttggcccctgtcctaattcccacccatcgccaccccaaggttgctactggggagagagtatagtgattgtttattcatgtatgcaaccagcattaataaagtttgtaatcaaggcaggaagaatcatctttaaaggaataaaactggcttattagcatattaaagctaagtgctcagttatactgcatttatttgcagcaataaacaattaagttccttgcctttttctaaccagttggaattaagctgctggatagattcgcccagagtttagtgaccctctcccttatgtactattaaaatcctactattttaaacaattttgggaaaggttagtttaaatgtgaatgttcacacactattattttgttgtaattttaaaattattttcaatatgtacagtaagtaaaaccaatctggcaaacaaagaattacttcctggaagtccttcttgagagaagcaatctgaaaattagaatagcaaaacagttattcaactattgtcctcactcaaattgtattctttaaaaaaatttattgttagtccattctcacgctgcttgtaaagacatacctgagactgggtaatttgtaaagggaagaggtttaattgactcacagttcagtatggctggggaagcctcaggaaacttaaatcatggcagaaagggaggcaaacacacccttattcacatgatggcaacaaggagaagtaacaagccaaaaggggaaaagccccttatgaaaccatcagatctcatgacaactcactcactatcacgagaacagcatgaaagtaactgcccccatgattaaattacctcctgttgggtccccccaggactcatggggcttatgggtactacaattcaagatgagatttgggtggggacatagccaaaccatatcaaccgtatataaaggaaaggcatcaaagctgaaaaatttcttcttttaaggaatcgggcatggtcttctctataaataataataaaacaaaaaattattttattatatataggtttttattataagctcctttaattcaattttagaagtaggtaagatatgaattataacaaaaaacattgtttacttgaagttatacaaatactcttatttattcaatttattcttcatagataatatctgagagagaaatgtttgaggtaattccaagctattcagaattgctaataaatgagtttgtaccccagttttgaatttttaatacatataaatcatgggtccatttataaataaagattagaaatttctttctacagtagattataacagcaaacttaaatcatcctatttatattttgatttcaaaaataaaatggaaattcaaatagtgcttcatcggttgaagatatttgctgtataagagttgactaagtttggtttatgaatataaatgataaacacaagaattatataaaattcattcccaattaatagtctgtaatcaagatttaatgtgttgctttttaaaaacaaagtttcaggtttaaatgagtcttatgcctgggtgtggtggctcatgcctttaatctcagtgctttgggaggttgaggtgggaggatcagttgaggatcatttgaggccaggagtttcagaccaacctgggcaacacagcaagaccccatgtctgccaaaaaaaaaaaaattagctgggcaatatggtatatacctgtagtagtagctcctcaggagactgaggtgggaagatcacttgagcccagtaatttggaattaaagtgagctatggtcacattggtgcactcaaaccttggcaacagagcaagaccttgtcgctaaaaaatatatttgaaaaatgagtcttcatttaatgtaaatggaaaaataatttaccatgttgctatttgtacttccccatacttttctgtggagcatgaaactgtttattctacaagcatattataatccatagtaaactgttccaaaatatatattcctttagttttattaaggataacttaaggagttaataaattctccagcttgttgctgtgatgtcttagaaattatactgcttccttttgtactaaaataaaccatgggttcttttgaatttacagtcgcagatatggccagtacactatgaaccaggaaagcaccaccatcaaagttatggagaagcctccatttgatcgatcaatttcccaggattctttggatgaactatctatggaagactattggatagaactagaaaacatcaagaaatctagtgaaaacagccaagaagatcaagaggtggttgttgtcaaagagcctgatggtaataactaactaaataaagcttttgttgtttgtatatgtatttataggaaatgaatgcatagaaaggaagagaacaaaaaaaaaattaaagctaggaccaccaaaaaaagatactgcctttcaacttgaaaaatacttgtttgaggcagatttatggatgcaactgccagatacaagtggcataagtaagttagcttagtcatagatatggctggaatgttgttggctaagctcactgtatcatagctttttagagttagacttcatctttgaaaccatctaacctccctttaaatttcttctgtgatgtggtagccacattgtcatttggtctctagtgagtgcagatggtgatagagcactgctttgcagtgagactgtttttccagtggtcagtcagcttgagttcttttgatctttgttttattgatttataatctgctgtcctctaactttgactctcttgctgtagttatgcctttgggacgaacagaagaaggctcttctatttttacatgatagcctttcatatacttgagaatatttatcttgttcctagccaagacatttctagaaagaaaattcacataaaccaatttttgtgggtggttttcaaagacctgttgtggtcctggctattttgtcattcaaagtatacttctccagattggatgcaacggctcatgtttagccaactaatctaaaaatatagagttggacagtagatggtggcattactgtttttagcttccatatttacttctttcttgtatttggtgcataatttctgtagagtcactttccagccatatttcccattctctgctataatatttgatattctgggagaaacatgtaaaactttaaagtttttttgtaccgtttcttttaatctctgaaattcaagcagttgctaagtttttcatgtccaattctcttgtctgttgtattagctttctttctatgccttgtgccatctatacatttgtaagtatgtttatataagttgatgtataaatgccaaaatgtgagagccccaatcagtgctttgtgatccactaatagagacttccttctcaacacaatgacttcttaactaaatgacttaggatctaattaactagcaaaatctatataaataagatttttttccttggctacacattgcttgaaaaatctaccaacattaatttaaaaagaagacttggggttttttcttaatttaatttcttagatctaaaaacactacggttaacttattctttaacttcttgttatttttctctcattgtttcccaaatatgatagcaataaagtcaagcttatttgtgataattaatagtatctctcaccctttctttctccatgtttcaagatggaagtagcatactagtctgctgaataaggagagaatatgtttgagaaagcagcgtttaagcctgatacatagaagtatgtcattagctgtttgataagtctccaacactaattagagtcattgattattatgcactatgtgatcatcaagaagattgggaatgttttctacatgcccacaccttttcttagactttaaattgtttaagttttacttctactttttaatggaaaaaatgactctacatagtaatcttgtttattttccttgttgtgtaacaatatcaggttttttttctggcaatctggttttatacaccaatactgagttctactttaaaagcataaataataatggctgacttttgtttgttttttttttttttttttttttgagacagtctcactctgtcgcccaggctggagtacagtggcacaatctcggttcattgcaacctctgcctcccaggttcaagagattctcttgcctcagcctccctagtagctgggattacaggcatgtactaccatgcccagctaatttttgtattttttgtagagagggggtttcaccatgttggccaggctggtctcgaactcctgacctcaagtgatccacccacctcagcttcccaaagtgctgggattacaagcctgagccaccatgcccggccttgctgacttactttttatgctagtaaactgtttttgttgtctggtgtgcacagtgcctagcactggcttatgtctcttgaagtcaaagttattaatacttgatttctgccgtcaagaagtttatatagtatagaaagacagacaggtaggactaggtgctataccatgtgatacagtctatctcagggcttttcaaagctccttccatataacattctcacctttggttatggcatagctggaaggaggtgtgctttagtttacagatcagaaaacagagtcaacttgaggctaagtgacttttccaaagagacttggctatcaagttgcagaaatggggtacagatccaggtcttttgtgtcccaattcatcgcttttattttcctctataaatatgatggttggaaagaatccattctaattatccttctgcttttaaataactttcattagatcttacacaatatttgcatgaatatttcctgctttcagtgttttgaattgattgttgtttgattatcttcctatataagttttttttgctggatatattgtgcttttaaaaaaacattgtaaaaatacataatctgatgtgctgacttggaagattagaaaaattaatttgaaattgattagttcccaatgttctgatgctgttaacttctttgctgcacttcctgtcagctacagtgaacagagaaaacaaggctttccataaattagtgttggactctgaggtagtactgaatttaagccaagaaactgggcttaatatatagccccagcattgacttccttctgtaacttgatggaagtaagttatctttttattctttgcttatctctggaaggggaacagtatcatcctctgggttaatctgcagggaagttatagaggttaattacatgtgaagtcatttaaaaattttaattgagtatatatgaaatcaatctaaaatttgatgtcattgtggctggagtgtatggcagttgtccaagttttagataatgattcttagcactgtggtttggttacaatagaagagttttagtaagaatttttaacagcttaaaaaatgtaaaggttgttatattttgtgatttaagtaccacttttctctactgtcttagagggagaattggaagaagagtggcttaaagaggccggtttatccaatctcttcggagagtctgctggagatccacaggaaagcattgtgtttttatcaacattgacgcggacccaggcagcagcagttcagaagcgagtagagacggtctcccagaccttgaggaaaaaaaacaaacagtaccagattcctgacgtcagagacatatttgctcaacagagagaatcaaaagaaacagtaggttttcttttttgatgttaaggcaaaggaataattgcttacaattaattggatcaatctggtttaattcaaatgattaaaaacgtaatgatcacctattctatgccaggcaccaaagctctatgcttgcaggaaacaagagagacttgcttcctgcctttctggaagttatactgatggggcagaaaacaaagctagttaaaattcagcatgataatccatgtattaggagaagagggtgtccttggagcattacaagtgactttaactccactaggggtgacagggacagcttctcagacaacatgactaccaacagttacttagagaaaagtaggattagggtattcttccctatctattaatgcttgtaggaatatttgatttttccctagactggtttggggatggatgaagtagaatgtgagggagctaattgcagctgaattacaaagcaggaactttgagacatgaagtaacttctcctttgtggtgttaaaagaaagaccttagacaaattaaatttaacagaatttaattgggtaaagaatgatttgcaaattgggcagcccccagaatcacagcacattcagagagactccagtgctaccgtgtggtcaaagaagatttatggacagggaaaggaaagtgatctacagaaaatggaagtgaggtacagaaacagcgagattggttacagctttgtgtttgccttttttgaatatggtttgaacagttggccacctttgattggtcaaaatttggtgattgacacaagtaggttacagtctgtttacacatccagttaggttagagttcactatatacagagaaaccctttaggatgaacggaagatatgtaaggaggcagctttaggttaaactttaaggtgtctagccttagcacagtgacagcacacaaaagattgagtaaatatttgtctaggtgattaacttgttaataaaagctgtggggtctggtagagactgtgggattgatgaatgaagggaggtatcagagaaggcatgataaaagtttgagaggctgggtgtggtggctcacagctgttatcccagcactttgggaggctgagactggagagttcgagaccagcctgggcaacatagcaaaacccaatctctacaaaaagcgcaagaattagctgggtgcggtggcatgtgcctgtagacccagctacttgcggggctgaggccagaggattgcttgagccctggaggtcgaggctgcagtgagctgtgttcatgccaccgcactccaggctgggtgacaaagtgagactccatctcaaaaaacaacaacaacaacaacaacaacaaaacagtacaagaactgtgtggctcagatcagtgctactcaaataagccagttggtggattgcctattacttacctgtaagggcatcaggagcttacagagaatataaatgatccttgtttctttcatcaaaaaagtcttgctgccagaaaaaaggtaaaaaatcagcggatctagatggtgttcttgaggtcaaagttgatttacattctggcttgagtgcaatctcggctcactgcaacctccccctcccaggttcaagcaattctcctgcctcagcctcggagtagctgggactacaggcgcacgccaccatgcccagctaattttttgtacttttagtagagacaaggtctcgccatgttggccaggctggtcttgaactcctgatctcaggtgatctgcttgcctcagcctcccaaagtgctgggattacaggtgtgagccaccgcacctggccagattttaagtaacttgctcagtgtcctgtagatagtaaacccaaatttgtttgactttgaagtacatgcttttaaccagtctctatcctggtatatttgcattttgtacatgattctgacattaagcatcctgaatatgagattctatttacactataaaagataacaaaaattgaacgattatttatgttaaaaaaggaatgaaagggtttatatttaaggtatcttcctgtcatgtagacactcttttgctttttgtagacattttattcttgcaagaaagcccttctagctgcagattgctactctctttgcatgaccaatttcgaatcaagtccagtccatcttacaggagttttggggtcattaaattgctccaggcacttgcttaagttaagcacttgcttaccacccagtggttatttgggatatccacttgtgttaaaggactggactggtttccagctgaagaaaaatgaatggtaaggaaatttagtattatgacattttcttcccaattggagaaccctcactaagggagttaagaggaagtgaaaagggggagggaatagagagctgagcctaagcaaaatataaattgtgggatttctgccagtctccaagaggatgttgctacttggtgctagaaacaacatttttccagcaagtttctggcagtgtcacaaccacatggtttgagtccaaggtaattggtggattgtatcatctgatggagtcattaagagagaactagcaaaaggaaattaaaataatgttaacttgcttacactgcatgcctttaattgaaacactgccacccattagaaaagtgctttatctcccccatgcctcaagcaaacttgggccagccatcttcacttgcagttcttctacttttgagtgagtgtatattcagctcttccatgttaaatgcttcctcatgaaggccttgctgacactaggaaatataatgcagaaatgaacaccatctgtactgccatcttcaattgctaaggaaaataattccgaccacatgctccaaaatatgtgttcttttgtgagactggaatcactctgctcattgtgccatgcagggccagcctctgccggcttgtgggaggagggaaggagaatgggactgctctgtgcttcaggggattaaagtgatgctgggtacccacgtaccacttctgtgacttggtagtcactgtaacactttcctgggttttccccatctctaagtggtgcattaatagcctagacgtccctagcctagtgcttttctaggctctttttagacttcaggtggaggatgaagtccttcgtggacaacagcttgaggtgaaatgtgtggtgagactacaatggccactttctgtctgagataaaatacagtagaattatcaatattattaaaataatttgaatagacctctttctgtggttgatccagactcttcttcctgacctctgaattccttctgaagccttacctggaaaggaggaagtactctctggccacatttactgctgagcagagtcggccatggtttaccatctccataaacctttggaaggccccgttccttgggcgtcactgccccgaccccttgaaaacaggaattccttcagatgttttaggtcttattgctggtttggtaatttagttacttatctcacatttatttcttgcttttttttttttaacttgaagaatttctgttttattagggacatgtacttttatagttttataacagcatgattgagatataattcacataccatataattcacccacttaaagtgcacaattcagtgttttgtagcatactcacagttgtgcaactatcactacaatcagttttagcacatttttattgtctccaaaagaaagcctgtatccattaacagaccttccccatctttccctccctactcttaggtgaccattagtcagctttgtgtctctgtggtttgcatattatggtcagttgctataaatggaatcatagaatatgtggctctttgtgactggttcctttcacttagcatagtattttcaaggtttctttatgttgcagcatgtatcaatacttcatttctgtttatagccaaataatattccactgtacagatagaccacattttgcttatccatttgtcaattaatagctactactaattttttaacatgtttgtcctttctcctcccctccatagtagcattcttgatgacagggacccactcgtgacttttttaatatttcccactgggcctactattgtctcttacaagttgtaggtaataaaatattttttggatgattgcttgttgattattatcttagtgcccctttttcactgtgattgttataattctgagtacatgtcttgtactctaaagattaataacaaaattatttacagtaccattttctctggttttgagttggagatgactaaatggcctgttttctatgtttaggctccaggtggcactgaatcgcagtcacttagaacaaatgaaaacaaataccaaggaagagatggtatgttgaacctgttctcttgtttttttttttttccgccctttaattagtataacagttacagtcttataaaacattaccttcaattctagtaagcaaattctattaaaatgttaatgtaaggtctcaagtggatcattatgtgaggctgagcatatagctggccttcaattttcttttaatgtgtattcctattttctgattcaaaatgcgtatacgtatcttcctgagtgcttatcatgtgccagatgctatcaggagatgtttacctcatttaatacacttgaaaaccatgtaatggttattgttcttaacccattttacagatgagtgaactgaggcttagagctgtgaagccactttccaatgcaacacagctagtccctgagccaacaaacttgcagcatcgttcttaaatcacaagctcctaattcatatatggggtaattttttagatattgtaggaaaactttttaaaatagttaagatttttatgggcaattgattataattctacttttcatgtttctctgctaacatttgttatttcagatttgaattagaaactcgaggtatggaagaaagtaacttttttttttttttttttgaggtggagtcttgctctgtctcccaggctagagtgcagtggcgtcgtcttggctcactgcaacctctgcctcccagattcaagtgatcctcctgcctcagccttcccagtagctgggattacaggcatgtgccaccatgcccagctaatttttttttttttttttttaagtagagacagggtttcaccatgttggcgaggctggtcttgaactcctgacctcaaatgatctgcctgcctgggcctcccaaagtgcagggattacaggtgtgagccaccatgcccagccaaaagttactattaaggctttattagtacttactaagagagaatttatagctatttcatttgtttacagaaagggaaaatattctaagtgaagttaatagatttaagcttaaaaatgtagtccttaattgttatttaacaaactaaaacaaaggtgatttaagtttatgttcctaaaatttagcaactggagtgttcatgccattaatagtgttgcatttggtttggaagtagtagtgggaggggtattaggtaaactgtggaggactgaggagtgttcccaacattcctataaaaatcctacattactcaagatcatatgggatcttttccttccatactttcctcagaacttctctctggcacccctgccttaaagataatatgcatgcacatgtatatacatgcatatatatttataaaaatacttgctttttattattctgtggatgtttcttcagttgtatgcattatatctgaatgaaatcactaggtgttttctcagatctatgtacctgcagatgctgaagtggcaagcaagctggcatagctaccctgcctgctagagagctgggtcatcaggagagacagatgggttttttgtgccaatgtcaatatgttttgggctctggggaagagtgactggcagttggtgaatggatgctgaggaaaacattgtccttttcttggtgttttcctcccttgccagggatcatgatgtaggctatatcaacaaaagttctggaagacaagttcataatgtgagcactttcctgcctggcttgcagcaggcaagtgaaatgtgacaaacttgctgcttgatttacatctgcttttgctggaatgctacatagtgggcatagatcctccaatcagaataacaagagaatgtgtgatgccatccaagtcactgagtattccctattgcacctgttctgggcaatgccatgctctttcactagccagtgaattaaccagtgtaagccaaacattggaaagttcaggatgaaatgcatggaaacattgtctcaggttcaaaagtggggctgtttctgattaaaatttgaaggcatgggtgacatagtctcttttaaatgttttccccacacttgagtttttaaacatgttccgccaatgatacttattctaaatgaaaaggttgttaagttttatagttgcaagggttgtcacattccaaattaattcactgtaatatgttcatttttcattcaatcataaactctattaaaggcccaatatttaataatacatttagaaatattaataatgccccaataattttttaaacttttatattgatatgtatagcttcttattttcttttgaatttctacagaggaaagaaaaatctttttttttttttaaaatagaagcaattgaatcttaaagtcaggtggttaaaaaaaattttttaaggcatttcaggatattttggacaactgaaaaacttaagggagatttgcaaaatgtttgtaacccagtgctattgtgcacttaaaaagagactagatgacagaaattttatttattttaggaccttaagagccaaaaggttgatctcagcattctgttcttattgagagtaggtaattaaaacatcacttattagccaagtaatcatccatttcttgtagcagtacccctcttcaaccctgaaactgtttttttctgtgctgtgcttcaacttgattttctattttaactagaactttgatatgcggtattttttttttgcattgcttttgaaggaaatgtgtgtgttaaatgtgtactaccttaattataattactcagctttacattcggcatagtccgttggtgtgggtgtgagtgtgggggtatttattgtaaccctgacatggaggtggtgagaagaaagagtagttttgaaattcttgcccacaactactcagctgctagaaaggtagcttctaatttaagaaaatggctaatcatttttttcctcttagaatagtttcctaggaaaccagtgtacatagtcacagtaaaacataaaagagaataaaccagagggaaaataaaattaaagttgtgctttgatattcatgttgatactttaaaaaattaatcatcaaaaggtataggtattctaatttaaaaaatggtcacaggctgttgagaaacataaatatacatggcagcagatgaatactaataatatcaacgggctttaaatgtattcttagttttggaattggcacaggtaaattcttactttcttaactgtgagattccatcaggaccagctgtgtaatttgcaaggtcagggacaaactgcacatatagggcctcttatttacatttcaggatgtaacagcagagcattaaaccaagtgtggaaccctcctgagcctggagccctgtgtggctgcacaggtctcatgcctgggaagtctactctgcatattgaatgggactgaataagactagattcatatttacttctaaacttgattttgattaaaacaggcattttcatttttaatgtaaatgaatataaacattatttttctgaactgcagactcttaatatatgtatttatgacatttatctattaaatttttaaattaactttagcttccatcactttgttgtgttcgtatgtgagcctgttataagcatgtgtctacactgcatagatgtattttgtaattcagagcttcttactatgattcaaaggtcaacagtgagaaaatcagtaatcttggttcttggctttaggtttttttctgttaattgcattaaaacaaaaaatttaccaaataatcaaatttagaagtatcttctccaaagcttaaacctggtgttttcagcaaagagatttttaaatgtaaattcctttctggagggttaacaacaagccaaaaaagccaaaacaaagttaaacttactatatccttgaaatcttgatgtaaatatgtgaaaattatttgactggtatttacagttgtaggaacttttatactttttgacatgatcaggtgcaaacccaaccattcctgtaccaggtacgtcctgacctgactcgcatagtgatcactttttggcactaactcttgttttggaatttttactatgataggtaggtaatattccagaaagtaaatgcagggtgtggaagaagtttattccaggaaactgatccactcagaggaaattaattaaatggtaaattactagctttacaagagattactgctcatcacctccttctttttttgcttttagtttctcagtgtagaataaaacaacaattaatacttcaaaaccttttgaggttttttattaaaagtttactatcttccagcaatgttttggaattggaacccagtttgaggattgtggtctcaaagactgcacaattgaactatggattgctagtcaccacagtctccctgcccacttcccatgcaccattgataggattcttgagtatactctttagtattaaaataacggctaagtattgcctagagaaaatagtactcttcccaaatgtttttatgtagcgaatgcattagaattttttttaaaaaataaataaagcatatgaattgggttctttccccccgggcccctagacgaggcatctaaccttgttggtgaagagaagctgatcccacctgaggagacgcctgcccctgaaacagacatcaacctggaggtatcatttgccgagcaagcactcaatcagaaagagagctccaaggagaaaatccagaagagcaaaggcgatgatgccacattacctgtacgtagtacactctttataaatatacatatatgtacatatacatatatatacacacacacatatacatacacacacacgcacacacacatatatatatatatagagagagagagagacagacagacagagagaaagatgaggcctcactacgttgcccaggcttatctcaaactcctgggctccagcaatcctcccacctcagcctcccaaagtcttgggattacagggatgagccatcacacctggctcaggatatatttttcatcagctttttattttaaaaatgtagaacccacggaaaagttgaaagaatagtatggcaaacaccatttggccttcatagatcaattcaacagttattaatattttataacctctttttcttttctatatctatctatatgtacttttttaaagtttaattcttaagaaatttaagctgaagtgataatcatatttaatatacagtcatatcaaaacttccccgattgtcacaatattgttctttatagcttctctcttttccactcccatttgggttccaagcaagagtcatatactgtatttgttgtcaggtctgtttggttttcttgaatctaggttagtctcctgcttttcttcaatattatcaaagagtccaaatcagttttctgattgtttcctcaggactggattcaagttatacatttttagccacatttactgcatggaggatgtttatgccttcgattgcatcatcagaagagatgcatggtatcagatggtccctttattggtgatagaagtttggtcaccaacttgtctaaggagagatgttcactagatctccccattataaaaagatacctttcctatgtgcaattaataataatttgtcatccttgagactgggcaaatatcttatatgtcaataaagcctattgcccagtggtttcaccatccatttgtaactttgcctgaaacaacaactaacctggtgcttaagaaatggctattttaaaattctattattccttctacacttactggctgacacagtcttccgtaattgcttcttcagtttctagcacaagatgttccaggctctctttgtaattttctccctgcagacttgaaagcatccatttctccaagaagctctggtactttttagcagcaaattgtatttagaaaccaagctctgtgtagtgaatgttctcattgctactgaatatcttgcattttctaaaaaatacatttattatgcagaatttcacacaggcaaaagttaaaaaaatggtattctgaacccccaaatacttagcactcagccccaacattcattagcccatggccaatcctgacctattcatacccccacccagttccctattctgtgttattttgaaatacatctctgaattatattttatcatctatatttctaaaagacaaagaggggattttaaaactcctaaccatataaccattattgtaccaaaaatgctaagaatttttaatttcaaatatctaagcagtgttcaaatttcaaattgtatcacataattttataatctttttatacagtttgagtcaggatccaaataagggtcatgtgttgtattgcaattagttaatacatcttttaagaattcttaaatctccttctctgtttctttctctctccctctctctctttccttccttccttctttcttcctttccctctatcccttcctctctctatttttccttcctccctcctcattaatttattaaagaaacgtggttattaaattgtggagagtttccccctctgactattcccctggtgtagtttaatatgttcttttgtttcttattaattagttgactttaaattgatcagattcagtttcacttttttgggggggagtcaagactacgtcagatatgtgattgtatgttttctgttgggaagctcataatatctgtttgctttcttttttgtcaatgtagcagctgttgctgatcaatacctggatccattaatttattaacggttacaaaattatgatctaatattttctttttatttattaatttggatatttctttgagaacaaccttctgaaagtggtcatttttactttctatttgttttcagaaattgttgacttattaacagttttcacctgtgaccaattaatgttttaatttgctttgtaaaatatagtcttaactcacggaattatatatatttgtaaaaatagtcttaactcatggatttacacatatttgatgtgatcctggacaagattttacaggcttgtctggtatattttctgttccagacctagactgatatgtttctgcaggaaactctgattccgtttagtagaaatagacttttgtgactatgatcaggactctagaagtgttcatttctctgagctggtcattacttttgagccttttcagaggacagacgtacatgagcatcttctgtcttccatgctgtgaattgtagttctcaggaaatggcagatgatatatttagaatatcacataattgcatgtttgcttcatcctaagttaatgcacagcattctcagaatatgctaatactaccatcaacaatatgattactagaaatggtttaaacttgtttttctttttttttctatttgtctgtgtgtgtgtgtgtgtgtgtgtgtgtatgtgtgtgtgttttgggggtacatcctaaaagggattttatacagtaaaattattgtgttttaggttgcttaggattgttactctttgtatcgttaagccatcagctgcatacctggtttggttaatttgctttattttattttcaatttttagagattgcttttcttgaaatttcattttggcttataagtatgtaaaatacttatatagtccaatagtaaagtcgaaaaacaaagtgtattaaaaatctagcttttatccttcagctaccaacctattcaatccctcctcttagtggcaaactttctttccttttaatatcatggtttatccttctgctcctaggtaactggtagctcactatgcacagtttcttccaccttgatttttgttttgttgacttagtggtgtattgtggaaatcataccatagtagtatagagaaatatttctcacttctttttattagatacattgtactccattgtacagatgtatcataatttattgagtcagtccccctatggcggacatctgaattgtttccaggcttttcttctatatatgtgtgtgtgtgtgtgtgtgtgtgtgtgtgtgtgtgtgtgtatatgtgtatatatatgtgtgtgtgtatatatatagatagctatatttgatatatatatttgatatatatttgatatataatataaatatatataatatataaatatataatatataaatatataatatataatatataaatatctataatatataatatataaatatataatatataatatataaatatataatatataatatataaatataatatataatatataaatgtataatatataatatataaatatataatatataatataaaaatatatattatatatataaatatatataatatataaatatataatatataaatatataataaatatatataatatataaatatataatatataaatatataatatataaatatatataatataatataaatatatataatatataaatatataatataaatatatataatatataaatatataataatatataatatataaatatataatatataatgtataatgatatataatatataataaatatatataatatataatgtatagttataatatatatgatatataaaatatatattatatataatatataatataaaatatatattatatataatatataatataaaatatatattatatataatatatattatatataatatataatacatatgtataaatatataatatataatatatataaatatacataatatatattacatataaatatatatcatatatcatatatattacatataaatatatatcatatatcatatatattacatataaatatatatcatatatcatatatattacatataaatatatatcatatatcatatatcatatatattacatataaatatatatcatatataatatataatatatcatatataatatatatctatataatatataatatatatcatatataatatatatctatataatatataatatatatcatatatcatatatcatatatattatatataaatatatatcaatcatatatattatataaatatatatcatatatcatatatattatataaatatatatcatatataatatatattatatataaatatatatcatatatatatatatttttgaaatggagtttcactcttgtcacccaggctggagtgcaatggtgtgatctcagctcactgcaacctccgcctcctggatacaagcaattctcctgcctcagcctcccaaagagctgggattataggtgcccaccaccacgcccggctgatttttgtatttttggtagagatggggtttcaccatcttggccaggcttgtcttgaactcctctcctcaggtgatccacccacctcagccttccaaaacactaggattacaggcatgagccactgtgcctggccttcttgtatatttttgaaaatctgtgtttatacctaatgggaaaagtaaaagagtatgcaagtgtggcctaaaatgatgatccactctgccagactatcctcaggaaaagtatggttttttgtgtgtgtttgttttttgtttttctcgagatggaatctcgctctgtcacccaggcaccatcttggctcactgcaacctccacctcctgggtttaagtgagtctcctgcctcagcctcccgagtagcagggattgcaggcacatgccaccatgcctggctaattttttatatttttagtagagacggggcttcaccacgttggccaggctggtctcgaactcctgaccttgtgatccgcctgcctcagcctcccaaagtgctgggattacaggtatgagccactgtgcctggccaataagtatgttttcaaagtgacagtcttcatcacaaaatatggaaaggttttaaattgaaggacagtagaatctaattaaacaaaatgaagtcattgttggcttttaagttgttgactcaaacagtggaatgaaatataattcatctccacttgagagctttcaaaacaaaactccctctgccattttcttctctgtttaactaatttaccttcacctaccttcttaattatattcaagttgtgcccaaagtttaaaatgacctctccatttctacccctctgttgttccatatttgccaaggaaactttaatctattcttcagagactagctcaagatcagttttcctgttcagtctttcctgatcgtgaacttatattagatcaaataaatatatgaaatcacctttgatttaggttgcatgctttagacattattgttaatctgtccatgtatttttttatgcaaatatgcatatactcatctatagaaactcttttttagtccgtttgtcttctagaaggtatggactcattgttaaatttctacaagtctttcccatggttgaaaaagtaagatttgtattcactactctgaggcaggtgtctaagtagataaaaccttaagttccatttctgttccatgctcctctacttctgtaaataagcagtaggctttatgtaatacattgttctctgttgacctcatttcatattcacttccttttcctcacagcatcgagcaacctttgtcaattctttatgatctctcatcgtggattcaaatttctcctcttaaatttggagatcaggttttataacctttaatttgctttagtttgaaaatttagctacttagtgtatacatgttatatctcagaaattatgctctgtaattatttattagatgacctctaggaggtagacacccctatttttcatacatggaaacatgttagagaggtaacttgacatgctgaggcttgacattaatgactaagcttttgaatcctttctcttgctttccaagtcaaagctagagtgatctgatgagtaaaaaagtcaagtttattattagtgatgaaatgcctaaggggcccctcatgcaaatcctacaaaagagcaacacgccagggaaagctacctagttaatttatggtaacacaagggaatcaatgaccttacatttttttttgaaaatttttattcttttctttttcctttttttttttttttttttttgttttgagatggagtttcactcttgttgcccaggctagagtgcaatggcgcgatctcggctcactgcaacatccacctcctgggctcaagtgattctccttcctcagcctcctgagtaactaggattacaggcacctgccaccacgcccggctagtttttgtatttttagtagagatggggtttcaccatgttggtcaggctggtctcgaactcctgaccttaggtgatctacctgcctcagtctcccagattgctgggattacaggtgtgagccaccatgcccagtcttattttctttaaacacatttttcaagaggtagagaacttttctcttgctgaaatttcactgctttctcttagccaatgaactgaaccattcagtctattaactaaacaaaaaacgacaggaaacttcataaatatttaaagctgctgctatgaattaaacattgggataaagaactaactccttcattaagcacaatgtttaaataaataaataagctcatgacatatatcgctaggtaaatcaaatgtttgaattaataatatttcaggattctgtaaacatttaccttgggtaatgctttaaacggctgtattacatgtgtttgacttattagacccaaagcaactgattttaatgaaacatttagggcttaaaaaaaaggtaaatatggttggttcagcattcagaaaatgaagcaattagcagaaatataggaccaaacatgggaaaaatgtgaccagttttgtgtgatttttaaaaaggaaaactcagtagaaatcacagaaaatcaggggaacacgaagccaatggccctccacctcattgagtttgattctatgctcgcctccctgtaggatgtgtgtctccattcatttagtggaccatgacagaccacccatagtgtgtcaggtctgtggtacaacagcgttacggaagtgattaagaagtggctcctctccttgaggggctcacagtaccacatcaacacctatcaacctagatatctccctgcctactctggtggatgggaaaaatggagtagaacagaatggttacaaaacttacgatttaggagaactgaatttgcatcttcatgacatcactggctttgtggccatgtttaaggcacttaactgagtctcagtttccccacctagaagatgctgtaataattcttattaggacttttgaaggattaaatgaactgtttttcgataagataattattattatcatttttttcttaccttgccatgacacataagaataaaggaagaccatgaaatgttgatattattttaaaagctccatgaaaaaaatataatatgtaatactttttgagtgctatttatcatttgatcttcgccacaaccttgtaagttaggttcagttgttctcattctacagatgaggaggctaaggcacagaaggggacattgtttgccaaaggtcacatagtaagtgatggaaacagcatttgccacctgtagtctgactccactctcttgagccctgtgcagtgccccatggaggccatcctgccccctgctggaaatttgcttaggccccatcttcagtgatgtccattgctgtttatttgatgttctcctaggaaaaaaaacacattacgaacggttaagaaagacccctttcctcttacagtggacttgaaggctctcttttgaattgagtttgcttaaagggaattagtttctcacttactaaaagtcataggttttacgagttgctgtaggagactgactccaacattttcatctcacaactccttcatacacttaaaaattattaagggcctcaaaaaccttctgtttatgtgggttatacctatggacacttaccatatctgaaaataaaattgagaaattgaaaaaatattaatccatttaatataacaatattatagttaacataaatatctttttctcaaaatggaaaatagccatattttctaaagaaaattaagtgtatcatggttttaattttagtgagtctgtaatgtctggctttagttgaagtcagctggattatcatatttacgtttgcattcagtctgttgcagtagcactcatttacatctggaaaactatactcacgagagaatgagagtgtaaaaggcaaaataatgcctcattactaattattaaaatagttctgaactttttggaaggatattggatacccccaatggtccctggactacactttgagaattactgctttaggacatgtcttttgccctagcatttagacgatgaagtgttaatgataagacgcaagaagtaccaaagcaaagggaataaaatagatgcagtaaaatcagctaatcagcaattgaattaaatgaaaaattcaaaggtaaacccaaactgtaagagaatgatcagttttagtaataggtaaacacaatggaattgtaatttgtattaaatgtacacactagtgaaatttgcctttttatcttgtggtttgctttctgatgtttaatgtgtttaatattaaaagatgatatttgagaaaggcagaaaaacacaccatgtgcttgtgattatgaagcaacatcttagtcccactttattcagcagtgaaagtaatatacaagttgagtatccctaatccaaaaatccaaaatcctaaatgttccaaaatcagaacctttttgagcactggcatgatgccacaagtgaaaaatcccacacataagtacttaacacaaaattagtttcattcaaattagttaaaatattttgtaaaattgccttcaggctatgtgtatatgaaacataaatgaattttgtgtttagacttgggacccatcccaagatgtctcattgtgtatatacaaatatttcaaaatctgaaatccagagcacttctggtctcaagcagtttggatgaggtgtactcaacctgcagtagcaaccacataaaagcacttgggcagtgctgggcactaaatctcacaatagccctctgaattcagtggcccatcctcttctttttgttgcccttctcctcctttccctccccctccatctcccattttacagaagtaaaggttaagccattgccataagtcacacaactagtaagtagataggtgactggtaagctctgaagtccatgctcttcgtttcccctgtgtccctcttaccccaatgggctgtagcctttctggaccaatcttacttggcttttgtgacaattaaaagatacataagtgtatgtgaagggtacctggcatgttctaagcatacactcatggctagtattcctctttctctcccccctacttgtcttcttcatgtcatcttcctctgtttccccctccccctcccccatccccttcccgtcccctccccttcattttccctctccccttccctgctccccttccttttccctctccccttgcccactccccttccttttctctctccccttctcatctccttttccctcccccttcccttccccttcactgtccccgtttccccctccccctccccctccctcccctcccccttttcctcccctttttcctcttctttttccctcacctcccccttttcccctccccctttccctccccctttccctcccccttttccctcccccttttccctccccctgtcctcccctcccccttttcttccccttttcccctccccctccttctttctttccccctcctctttcttttccccctcccctccccctctctctccccttccttctccccttcccttcccacctcttcttccccttccccctcatggattgtgcttgacttctagccatccttttctgaaggtcacttaactagaagtctttttctcctggttcactgtctctcttgtcctctgagccactggtattaatactccgagtttgcggtctgttcccgttgtctgtcagactttggaagttgactcccgaaccctccacagctttaggggtcgtcatcatgacaggatcactcttcattctgactggagaaattctgtggcttttcttatcacttattctgagtataacttctttctgtagttggtttttccttcctgcattacaatggaggttaggtactgtaagcttttactatattaatgatgtttattttagagtttcagattgccaaaagacaaaacgggtaccacaaggattggtgacctcgcaccccaggacatgaagaaagtttgccatttagccctaattgagctgactgccctctatgatgtattgggtattgagctgaaacaacaaaaagctgtgaaaatcaaaacaaaaggtaatcatgaaatgataaacccttggatttatttctaaaatagcaaggatggacttggcttttttgcagtatttctgggagacagggaaaacacctgcaaaataaaccaacacttgaatacatctaaagtttatattctaagatgttgccttcaaaagttttataacgatagagatacactgtgtcctagactatagagaataaaggcatagtcaaagaatttaattctcatagaaggaaattctgaagcaaggactcttaactcatttgctttctcctttaaaaactatatatttaaaaagatacatatttggtacacatatttatttatttccagaatcagatcttgaaaaatgactttaagacagttgattctaagtgactacttttggttattcattggatagcaaataaatgggctagttagtagtctgcccctttgttcctggacattctaattttacctattttgcaaagacattctttcccctattaagaaaataccaccattgtgacaaaacaataccactagattgtactcatcatggaaatatggagtggttttttttttttgttttttttgtaagtaccttgctttacccattaaataaacagtttatttttaatgatataatagagaacagatacctcttcagtttttgtttctccagtaatttattggtattgaaatccacataattctctgttgacaaggctttaccttaggaatctttgtcctcttgtttaaccttagaagtatctcctaaagagaaaccaagaatgaggattattgaattgctgtggtaacattcacaaagacaagtattcacctgatttaggttttagaggcaattactctgtaggactgaagtgtaccttcccttctggtcctgtcatgctgggccccagaagacctcattctgtgcttagttcctttgagtattttagcttacacaaagccttctccaaacgtaaaatagaaatacaatttaaacagttgtggttcagtgcccaagatttttaaagtggctaagagtttttttttttaattcttatgttttagaattgcatcctggcaaagaaacgttaagttgtttatatcaaggctatcactgttaatagactttctttccatttttatttaatacctgtttgtcttatccaagatactgattttatgttataccctagacccttggcatccttgagattgcatcttttccgaattcccaaactgaaaagttatttactgggttactggcgttcttttgaatggcatctcgattaagtgtcacaatatccaatgtctgtcctcataccacaagataatcccctttttcatgttcacagatgattttcatttccatgctgatgtacgtcataaaggaaaaagttatcactttggtgctaaccgtccactcagtgatgggggcagggtggaggtgttggtcgaagccatgttcataccagactcaaggctatgattttaatttagaaaaattgtaaattattaccatcatttttttctggagctatttctaagtatatacaatcacaaagttaaatttaagagtagcaagtatctattttctaaagagaaacatttgtagaacaagatcatgatcttgtctgatttcttagaaagcaaatatttgtattttgctgtattgtaaagtgttcaatgtctatttaatatggaaaagatgaatgatatttgctttttttggtgataaaaacggtgacagctctgtcactgaggctacagtgcagtggtgcagtgacggctcaccgtagcctcaacctcccaggctcaagctatcctccaacctcagccccccaagtagctgggactataggagcctgccatcatacctgcctaatttttttttatttttcataaagataaagtcttgctatgttgcccaggcttaggctggtcttgaactcctgggctcaagcaatcctcccaccttggcttcccaaagtgctggggttatagacataagccactgcacctggccaatatttgcttttaagtaagaatttttaatttgattacatttagtaaattatttggatattttgcatgctctcacagccctctgtttctcttatgcagcagtttgcacttttctaattatgttggtaattatttgcaatcatttgtttagttgtctttccttgctacattcctctataaggcagggccaggattttactattggccaccatatatataatgttgagatgctgtcattcacttagtagttgctaaataaatagttgtctgatcgacagtatcagaaatcttatgctttaacatttttatattaatattttatagattgacaaaagtgaggaaatttcattttttttcttgcagattctggtcttttttgcgttccattgacagcgctattagaacaagatcagaggaaagtaccaggaatgcgaatacccttgatctttcaaaaagtaggtaggcttggattggtcagcatagagagaacatacttaagctaatagtggtttttgtattcatattattataatacagttttccaattcatatactgtcatgttttgtactttgattttctattcaggaagcaaattggtttcaagggctcataagttttatattcatggtgatgctttctgtgttattactgtaactgtgattacctggcgtcattttcctgtcttatattagctggctttgtataattgagatttcaattctataatacataggagtgggaactgcttataaatttctagggaattgcatcctcatgaatatttcatgcctgtgtatatttcctcagcttttctatttacagtgaggatgtccaatttaatttaccagtgcctatttccaaagtaggcaaagaaaccataaagtagaattagaaaatgattgctaaactgttaagtcacttgtgtagtcaacactcagttattcataaggggattatctgtggcaatataaaaatttccgtccaacctctgagccatcattgttcagaaatacagattacatttgagaaaagctagggaatgcacagtgaggaagacaggtcaactcagttgtgaactacccaagccgtagattctttgcagcagcccaggcatatcaccgtttctgaaatttcttgggacagtagaaattgatttgcagttaattggctcagcaaactcatccagtactaaggctcaatctacttggcacttattcttcccctcttccaaaccagtcaattaattccgtcttacctactaacctttggtgcttttttcccctcatatctaccactacattcaaacctgcatctcattatttctcctgacaaactttgttctatacagttgatcccacccatcagcctcttttagccactgcatgcagaacatgtatctatggagagctgtcagcagtacctgtgattaacaggaggaggctgacaaatacaggctacatattcaaattcttctgtcagtagcagttgcaatttactatacaccaaagcctatacaaagcagggatctcagcagcatcctttcctggggtattagtcaaagttctccagagaaacagaagcaataggatatatttagagtgagaggaagagatttgtttttttttaattggctcacacaattgtggggctcacaagtctgaaatatgtagagcaggctagcagactggaagctcaggcaagagttgatgctaccatcttgagtccaaactctgcaggctgaaacttaggcagtgtttctttgttgcagtcttgaagcaaaattgccgcttctttgggaaaccaaaatcttttaggccttcaactgtttggatgaggcccactacattatagagagtattaaataattttcattattcacagtctactgtgacaaccaaaaaaaaaaaaaaaaaaaaatctgtcactgcaacatgtagactgctgtttgactgaacacctgggcgctatggcctagccaaattggcacacaaaattcaccatcacaccacagaaatacagtgagcttcagtttctgtggaggttcagtgatgccacgtgatccggctgaggattgcatccagtctattaagaaaaatcttcctttgtcattttctcttgaagttttttttttaaatttatttagttggttattttacatttttggtcccttaacattctgcagactctggctgtcttatctatttgaaggattggataatggccctaaagtatttttgtttctataaaaaataaaggagcatataaaaagtttacttgtagataacactcatctgtttgcatcccttgtgaattataagcaaaaaatcacagtgatctatcacaaaaaaagttttgatttatcagctgacaactcaattaggtcatatctgtattttgtaaaatggaaaaaattagaaacgactgatttgcaagaagattcattaccagtctttagaggactataatttaatttttgagcttatatacccgaaaaggacactaacaaagcttatctaatatctatgaacctgtacctgttatattattttactcagaggtacattgtttaaaccttgtgttctcagaaggatgagggaaatagaaatattgttaattttaatctatgaaaaaagtctgtcttataacctaattatcaaatctagtgttttcactgtcaaatgaatcagccaactcagccatactttgtgtcaaagagtctgtgttttcatttcatttttcaattcacataagtatgtaatatatattttgagaaatgctatgaaaattactgataaattacagaacatagatacattagtaacagcatcattaaaatgtatgagtcaatatagttatttttcatctctattttaatcctgataataaaaggaatgctataaagtattatttatattttaataatgcaatataatgtagctaaaaatgttattttcagtgagatatataagaaaacacatggcattccttctgacgatatatgtacgtaactctattgggtgctggtttttagccttagagaataatgaaaaggactcaaatattaaaatgcagaaattacgctcattcagttatttagaagtcacaatcactttttcctgtgtacttaatgaaagtgaaaggcatatattgctgaaaactaatttgctccagcagctagcatacaattgtactttttgttaataggactagaaacattttaaacattttataagatcaaataaaatgaaaattggctatacattgaatattggttacattaggttttaaatgctttattttgaataacgcccatctgatctaaaataattcgcctaaaatttttgctatgggattttatccagtgttacttgaaaaatgtggtcttggaaaatattccagaaattttttttcttttctttttttttttttttttgagacagagtctcgctctgtcgcccaggctggagtgcactgttgcgatcttggctcactgcaagctccgcctctggggttcacaccattctcctgcctcagcctcccaagtagctgggatcacaggcacctgccaccacgcctggctaattttttgtatttttagtagagacggggtttcaccatgttaacaaggatggtctcgatctcctgaccttgtgatccgcccgcctcgccctcccaaagtgctgggattacaggggtgagccaccatgcccggcctactccagatgaatttttaaaaatcctgtactgctttgactgatcaaagatgcttctcttttcctaataataaatccttaggagaattttgagactgctatgcttagttcttactgacttcctcaatatcagtgcatctttggccataatataacccaggaatagaagaggtgaagtgtttaaagaaaagttgacatctcttccagtgtccacatactacaatatatctaacttcagaatatccagacaaaggtcaaaatacctcatttatgatgctttgctcctaacagacacttttatgtgcaagggaaaaacagtaagctccaggtagtttatagagccttgtttaatcattaaaggaggcttccctgaaaatttttttttttacattcttttgatactctagaagattttatgccttagggcatgcagagaatattatagtaagactgtggatgagtgaagaataggtctgtcttttataaagcagggaaggcaattgtgaaatgagagtgggtgccagggaggaaaacctatatgatgctaggaaatgccttatattcaaactgaggacaggaaaactgattttcttaaaatagaatatgttttatacggcctttgtgtactgctcagggaatgcctactccaagaagatcacgttatcaagaatctgaccactcttattgtcttcttagcctccagtagtcattgtaatttctccatttgccttctttttgcgggtttctgcctttttaaaaaacaaaaacaaaaaaatgctttttgtgggaatctggagttagatcagcgtattcattgggcatcaggtatgacttagaggccatatacaaggacatttttctttgtttaacaccaaagacttaaaaatgaatatttgcaaacagtcttttttctgcatgtcataaataattctttcttggaacaagctaaaaatgagatgtaaatatgcaaatgctagattttcataagatttatttgattgcagaatgtaggtttctggaaaagcagaataaatagatgttcttagttgcttttaaacagtgaacatctttattctgtttgtttggagtaccacagctgttgtgtgaaattacacacttctgttataaagtagcataaggcccaactttttctaaattataacaaaagtttctggacttattgttttgaaggacagtggtagtaaaatagcattcaaaacctcataaaatccagtttacatgtcattgtaatcagttttatttatatgtgaaacagatgttaaattcggaattgtacctgttacaaatacggaaattagaatgtttctctgtttatgcacagctgatttctcgaattgaagagagaggtttggaaacagaaggcctcttacggatccctggagctgccattagaatcaaggtaatctctgggttctactaatgtaaacattttattgtttatttacacttatgcattttaaaagctaacttgtcctctctaccccttttttccattgttagtaaagtagataaaataaaacaataaaaccttttaccattcagtttagtttttctacagtcccttctggtttttgctaagttttttgttttgttttgttttcaaaatcaccatattacctataataatactatgacaaaagaatgtgatgagttaaaatattaatggcgtggggatagttgtgatagatttagccaggatgagtagtagcaattgagtttacggaagtcagggccgggcgtggtggttcacacctgtaatcctagcactttgggaggccaaggcgggaggattgcttgaggttaggaattcaagaccaccttgggcaacaaagtgagaccctgtctctacaaaaaataattttaaaaaattagccaggcattgtggtggtcacctggagttccagctactcaggaagctgagtggagaggattgcctgaacccaggagtcccatgtggcagtgagctgtcattgtcccactgcactccagcctgggtgacagagcaataagaccctgtttcttaaaaataaaagaaaaaacactttgggaggccaaggtgggcggatcacgaggtcagaagtttgagaccagcctggccaaaatagtgaaacactgtctctactaaaaatacaaaaaattatccaggcatggtgttgggcacctgtaatcccagctactcaggaggctgaggcaggagaatcgcttgaacctgggaggcagaggttgcagtgagccaagatcgcaccattgcactccagcccgggcaacagtgcgagacttcgtctcaaaagaaaaaaaaaagaaaaaggccaggatcatagactcctgcagatgggggaccttgacatcctatgcataattagtcttagtgagccggccagacgagacactctcaaccaccttcctgattcacacagttccctgtcttgctgcatccagggtagcctgagtctggctggtgaaagaataattcctagacttcccaatttgagccatcccttctcccttgccttttcttctctctggatgacagttccttcccactgttccagggtaccacgtgtcctcctgctgtcatctttgtgcctcactttttggcctgggggataaagcttccaatgaatgcatgataaagatggaattaccctacaggggatgcatactgcatatcccctcaggggatttaaatgtaaaggggactcatacttggaattgtagctgtatctggaagcagccattaactactaacttttaccctatcttccaaattcacctttagctctgcactgagatagcacaagtaaccactgcccacatccaatacattgtcttcctgaatttgaaaatccaagagaaaataggagaaaagagagagaatctctcttcattttcataaccccattctttatgaaatcgttagagctggatcaggactaagtgtttcttggggagtgcacactgtcctggcctgcttctaatgggctgtggtgttgccaggattggaattactctttatacatttcacagtttgcatcacctgctttttttgataagttgccttgatttaggacaccagtttcggcctccttggctcttactacatagtgatctcattttaataggattcgagtaacctgatatattctgatcataattttccacttgtgtcccctgggtttggtgtctggtacttagagctccctgaaactgtggtgtttgtaagtttcatagcttgtcattgtctcacttcatgtaacacctatagcacgtttgccactagtggacattgtgtgattctgagacgagttcttttaagtacattcactaacaaagatataattcctcagaaacaggtaacaaacataacttcatattacccacattggcaagatagtcctcaattcaccgagttcaaagcactcgggccctcactagcagactgcaatggccagctcacaggaggcaaaaatacatttacttcagtacagaatagtgaatataatgcagattttactttgcaacgagaaggctggcagaaggacaagtttaactaagtgtaatttctaagaaggccaattaagtggattcagctggctcaactcttcaacccagcctgttgtcatatgccaaattatgcagcagctggtccattataaataatttaaaagataatatgcaaaaatgttggttgtctcttttccccctggccccaccaaatttctctgtactattctctctccctctccctccattttttctgcctctcttctctggatcttcctctgttgtcctttcctccctcattctttccctgctcattctttcccccctcattctttccctccatgccccctctctctcctcttccttccctccctatctcccactccctttttctatcttttcctccctcctcttttttttttcctcttcctccttttctcactccctcttccctcctctctatttctttttctgtctttgccactccccttcacctatttcatcaattacaaaaataattgggggtagagaatggttgttgtgttaggaagagaaaatgtggtaatttgccttacaagaaaacaaagaacatactttgggagaatggtttcatgtaacagaggaaagtgacagaaacttgtgatggtttttaacgtgataggatttatatatagtaaagaagtatacaaaaaatagtaattacaaaactcaattgatttattagtaataatttgcctgacaaattttgtagagttctgaggtaagtgaactagatatttctaattctgcatggactcagactgttttttgcagctggcagcaggatggctgtgcattaaagacaggtatattgatgtattttcttgcctcgtttactataaaattgggttttccatttcccgtaggtgactaatcagaggtagccttctgttttagtcccagagactgattatgtatttttttatgtaatatacttctaaatttaaaacatatacttcttttttaatgatttttttcttaatttaacgaagatttataatatgtagatgaagcccccaaatggaacaattattttaaccagtctcttaattaaaactttattacttacagtttgtggaatgtccaggaaaaagtataaattttaaaatgttttttggccttaggtacagttttttgttggtaaagtacatttggattagaggagaggagtagttttttttctgagtaaaagaaatattgacttttggtagtctgatttgtcttgtctaaagagcagagtctcttgaaagtgaaaatgtgtcatactctcagcaagaaaaaaaatgcacttctagctgcttcttttttttttttttttttttttcgtgcctatcagaatctttgccaagaactagaagcaaagttttatgaagggacttttaattgggaaagtgtcaaacagcatgatgccgccagcctgctgaagctcttcattcgggagttgccccagccactgctcagtgtggagtatctcaaagcctttcaggctgtccagagtaagtgctatccctctttgaagcagtccttctgctggtgccatctatgttaattgttttaatgacatttggcatcacaaagaacgcaaccagacgtatttgggtggacatattgactcaactgatgtcagtgggtgctcagctgccatgcattgttttctgtttttcttataaatatgcattcctgagtaaacagataacagaatgttctctttgggtacagattaattgcacgacatttaagcaatacaatatatttcagtgttaaaacctggaaacttcatgtttctcttataatagaatgagtcacataagatctctgatacaattttcttgccaagtgttaaaaagcaacacttactggagaagctgtggatgaacagttatcataaaagcacaaggagaagtggtagggtctctgagcatttcttgaaaaattaaattctgaggttgtcatgcagaagtgtggagcaaagcattttgctgcctcattggtggaaggtcacaagctgcttcttatgtactgccattttgtcgtcttgggcaagctacacattagtgtctctaatagttctcgattctttttccagtgaacctagatcttataaggtttatctactggcctaattatccattttacacctagaggccatgaagaaaagtaaaaatgccatcactgccttcaagtaactgtatctttatcttttaaacagggacacttataagaatgaaaaggggcactattaataattatggtgagctcccagcactttgggaggctgaggcgggcagatcacttgaggtcaggagttcaagaccaacctggccaatatggtgaaatcccatttctactaaaaatacaaaaattagccaggcatagtggtgcgcacctgtgatccctgctatccgggaggctgaggcagagaatcacttgaacctgagaggtggaggttgcagtgagccaaaatcacaccactgtactccagcctgggagacagagtgagactctgactcaaaaaaaaaaaaagaataaattgcggtgagctacagtttcaaccagaactgtaccaggctattcttaacacatacaatattgagatggtttcatgagtcatctcgtatcatgacatttcttcagaatttctaggagagacggaactgaaatctcttctgtttaaagtatttttttcttaacatgtttcttctttaaatagaataaattaccttctgtgggaaatattttttaatgtttaaattgtgctacgttgcatacatttcctggatatggattaaaggaccaaatttattgctgaaaaagaaatgctggaatgattctaaatatccatgagtattacttaaatggggtaagggctgctgaaaatgataacatcaatgataataatgcacctcttagactgttgagctgctgcttcgttttctaatttattccacaggcatttataagcacctattgtgttccaggccctattttacatattcctgttggaactgatggactcttaccatgcatttgttcactcgccattaaaagaaacaaaccactgttacggacgcaccctgatactgtatcatggaaggtccaatcctctatgtcttttcattggggaataattatcacgcagaagttaaaattatttccaaagcactgttgtgtgtctgcaaacataaggccgcacgtcatatgatcacagttggaagtgagcattctgagagagaggaagctcctaacagcagctgcttctgctgatctcccacaaacacactctcaacaaggcttgcagctcagtcgttgtgtcttacattttacagtcatgtttatgccaaataacttttttcttaaaaagtgaaaaaataaagtaaaggaaaatgttcactgaagaaaagagttcagatttatttaatttgtctgcagatcttccaaccaagaagcagcaactacaggctttgaaccttcttgtcatcctcctacctgatgcaaacagggacacactgaaggtcagcttggttaatttacattaaatatcccttagaagtaagcacagtaatttttcattatttgtggcaaaacaataagatgtgtatcttggacatggtcataaaagtctataaagaaaaagcctacttttaaggacagagggtgaaagcctttaactctttatgaggttgttatgttactaatgttattaagtttttgttttttttaattttcactgtaacatttcttcttccaaaccagacgattgaggttcgtcggttaatggaaacgtgggtggttttttgttttttttctccttcttatttcttttttttgcatttatcaaattatatttaataagcaggtagcagtaaggtaaaatataaatgtttaaaacaaaaatcctaagttttatcaaatataacccactactacctaaagatatgacagtttgtagtttgaaatggtagattttgaagtgagtcataatggtgatttgacacaattgttagccaaaagatagaccaactcaaacaaattctaattatttctctaagggttcatccggagtttctgatttatatcaccattttgaagtgatttgctctaatgtttatataacttaatatcatctactttaagtgttgtcagaagctcttataatcagggattgtgccacactgatttattttccttaacagcagagtttatagagtagttgtaaaaggtttaattataaactcttagaaaaaggaaaaaaaattaacttagtaaaagtattatcttaagtttttcccttgccttaaaaatattttttatatgggtaaagggcttctttaccctcttcatttttttctatttaagatgaaatctcatgacaagagctttcaagttaagaaaacaaatttactagttggtacatcttggaatttttttcctgtaattcattaaaactccttgaattgtaactgcatgagtgatagttctttaatgcccatggaatgaatattaatactcaacttttcttgatgaagcagcttatggggattactggaggtaaaacgctacgtccgctacaggagaacttccaaagggttattccctttcctaaatcagaaaaaaagccttttgcttcactggttgtcaaatgaataacccagaagacagcattaggttttatttcaatttgcttttgagacagaggtcaactcagaaagggttatattcaaagagtgtgtgcccagggctactgtgtaagtgtgtgtagattgtggctgagacagggacatatggcccaggacaaagtggggctgacgatctaacatgtcctcagcttgtcagcagtgctcccgacacagggcttcaactactcagaaatagggaggaacatctttttcttactcattgacgaccctatcaatgcccagtgtgcagtgggtactggaaaacttatgatttacttaagatacccctacattcaaatgagttcaagtagttgtaggaggaagcattcaattcaatatggctgctttgggtgtggctgagctggaactcttcttcgggctttgccctcaaagtcccaggcatattcttttaaaaattctgttaaaaaatagttttaaaattataggatagttcttacattttgtgtatgaggctatcggaaagataattttataattaaggggggggggagtactatttttggtaaaaaactggaagatgcaaacaagtaattttacatgtttacttaagctttagtgacttaattagccagctctgctgaaggtttcaaactagaactttaataatagaacatttgaacaagaatgccatatgtgcaaagaataagccataaatttagttctgtaaaagggaagggaaactccaatgcaatataatttcaggaagtctaacgcaaaattccctgacttatccagtgctagcagcacgccttcagttgtcatctgaaggacagaatcatgtgcatggttgtttggaatattgctacagcaagtctaagggttaggaggcaccatgttaaataccacatcttggtgtggtagtaaagtgacaggtgtgtttgggcaagctgcttaactacagttacttttcactttgaattatggtgcatttggaccaatgatcacacctacctttgacttggaacaatagtgaagactgattttaagatagcaagaggggatccatgttaatataattcttgacatttatcttttttgtagttttaagaagctcattatatacattgtttcaatccttccaggctgagagataagtactcccattttacaaatcagaaaactttaaagagcagaggtatgtaaagatgtaacatcatacccagctactaagtaattgtgctggtactcaaacctggcttttcagagagtgaacccggtgattgataccaccaggccagtgataaagtaaatattttttgaaacaggagaagttctcatgagtgtataaagaaaatgtgatagatacacacagacacacacacatacacacatacaccatgtaatactactcagccataagacagcatgaaataatggcctctgcaacaacttggatggaaccggaagccattattctaagtgaagtaaagcaggaatgagaaaccaaatattgcatgttctcacttataagtaggagctaagctatgaggatgcaaaggcataagaatgatacactggacttttggaactcggtggaagcgtaggagaagggtgagagataaaagactgcatattgggtagcttatacactgcccaggtgacaggcacaccaaaatcttagaaatcaccgcaaaagaacttacccatgtaagcaaaaaccacctatatcccaaaaactattgaaattatatatatatatatataaaggggaaattctgaaggttcagatagaaaattctgcagttccttcagcaagggctgggctaacatctcgttaattttatgtcaactctctctcttattctctagtattctgatagtagtattttgagtaacgttattacatatgcacaccacaattaaaacggtttattacctaatgtctgtaatttatgctcataaagaaagagatacactggtccctgaacaattattctggtctctgtggaacaaaattaaatattttttccaaacttcaattaatcttttgtcctcatttgagaacatgttgttttatataactttatgcttggattacaatttaacttcctgagcactgtactagaaattagatacataaatctcattgttagatattaaagctctgtccttaatttgtttcaaagtttcaaggtctatatagcagttatacttgattcaaaagcaacctgttagcacttacaggaatttttttttccagaaattctttggaagatagatactttttttcctttttccattttagtatagtatatttggcctttttagggtagggattttaggctaactctgaaaaaatgattcttttaatagttaagaatttagaaacaaaagccagatagacctgtaattaaattctttctcaggatttgttagctgtatgaccaccaggaagttacttacattctccaaacattgttttctgatctgtaaaatggaggtaattacagcatctgtctccaagttaggattaagtaatctctatcgtgcttcataaactgcctcattcatagagaacattgaatacctgtgcagttatagttactgttgttctagaacaaaagaagaaggcaaaagaaaaatctgaagccttaagtcatgttagagtagggtgacctcagctgcatttgccttttggagaaggtagtttcagaggacaatgagtgtctgcaataggggtgggtgtacgtggcatcaagctgagcataacctaacctgttctgatgaaaagtttcttttcattcattttaaaaaaaattctcagctgggtatggtggcttacacctgtgtaatcctagcactttggaaggatgaggtggaagtgtttcttgaactcaagagttcaagaccagcctgggcaacattgcgagaatttgcctctatgaaaaatcaaaaaaattagccaggcatggtggcatgcacctgtggtcccagctactctggagactgaggcaggaggatcacttgagccgaggagtttgaggctgtagtgagctatgatctctcactgcacaccagcctgggcaacagagtgagacctggtctcaaaaaaaaaaaaaagaaagattctctttggtctttcctcatttccccgctttctctatcacaatattccctcacctctcttttcttttctcttttcttttctcttttcttctctcttttctctcttctctcttttctcttttctcttttctctcttctcttctcttctcttttccttttttgagagagggtttctctctgttgcctaggctggactcagactcctaagctcagatgatcctcccaccgatctgggactacaggtgtacaccaccatgcccagtgcctgggactacaggtatgcaccaccatacccagtgcctggctcattctttataagttccacatcagccagatattgattgccttaaagaaatgagactgaagttgaatgaccctttttgagggaatttttaaaaatctctacataggaaagtacagcatttcctgaaataagcaaatgtttgtatgatgttttacattacttttcagctctccatgactcccataggccagaggtctgacacttccccactcctctctctgctccctagttcagctatgtgccatctctgcttcattccccagcaccatggtccttagtagaagcaaatttccatctcagggagcatcaaccaaatggagaagctttggtaacagggcctgctggatgtgattagttgactgtgcttatacacaacttgttttttcaatgaaataaaaattgcatatgctacagtgctttaatcttttatcttcatatatgacacaaatctcaaagagtcatttctgtttcaggcccttcttgaatttctccaaagagtaatagataataaagaaaaaaataaaatgacagtcatgaatgtagcaatggtcatggccccgaatctctttatgtgtcatgcattgggattgaagtccagtgaacagcgagaatttgtaatggcagctgggacagcaaataccatgcacttattgattaagtaccaaaaacttctgtggacagtaagtatatatcatatgctttggtcttagtagtttaaaaaacaaattgcatgtttgttattagctttattaatttacatttaaaatttgtgagtgcagaaaatattaaaaacattttattcatataggtaaggagggccctgtgaatttctgttttaaaattatgtcaaaacatgccttgtaagaagtactttttatttacttctgcctattttcccatttctcagtgtttaggcctgctgtatttttaaaagcccatgctatcttggtttcagattattcagttctttttcatagaccctttattgaaagggatgcatgcattttgtacccttattaactgagaacatcttcaaaaatggtttcctctgttttacacttattttgagcttgttttgacagcttatcagaggatggaagtggatgagaggcttcgttgattaggtgctcattttccaatgaaatttataatttttcaggaggcatcttataagcatttaggaaaaaatgacctaaaggaattccaagcaaaattataatattgaatatttcaatctcttatttgaggagcttccaaacattaatttgttaaaaagacagagtgatgatatttagatcctgaagtctttatttttataatccataaaaagacaactgatgtagatgatttcaaatgtgtttttttaataaaaaattaatgtccatttattaaatctcaatgtttgaaatgtcaaaattatttcatggttacattttgataccttaaaatattttgtttttgctaatgtgatttcttaggataaatttgttctggatttttgctagctacctatcagctcttgtttcttggggagttctttctctcatgacagcagcggctagctggttattagaaggggacttgaggttagctagcagggctgtaggtaggaggctgcaaaaggaaagacctacggaggtggcttctactgctcgtcacctcagggggtctccagtctggcatagaaaacggccactatgtccttgaacttcacaaagcctcttttggaaccttccacagtgggtggcaaattataccacgtggatgccctgtacacctggtaagtgaataatatgaagtattttcttttcacagatttaatgaatagtgcatgtaaaatggcagtcttatcaaaaagagaaactctttactgtttttgaaatttaaaaaaatataatttttttttgtagtttaaaatggtggcatttctttttcctctctaagcttaattccttttctctatagattcccaagtttattgtaaaccaagtgaggaagcaaaacacggaaaatcataaaaaggataaaagagccatgaagaaattgctgaagaaaatggcttatgaccgagaaaaatatgaaaagcaagataagagtacaaatgatgtaagaaaatagtggagatatgtatttattcagatcttaagtatttttttaataccaaaattttttatttaatgttttcatagtatgactttctgccacttattaggctgtggtgctacttgtaagtgaaagacatcagtaactgtcttcctactactgctgctaatgatcagtattgacagttggtcaggtgttggtgactcagcatgtgagttgttaatggggaacaaaggaagatatcaagacaagactgaacacacacacacacacacacccctacacccctacccctacctctacctctcgtgcggagactctagtcgcctactgaatatataatctatagtgagtaaataacatcatgtgaaccactgacatttttttctaaatttttctcatctgtagaatggggaaaaataactaatccagatggacaaataggttaatgtttgtgttgtgcctaggattattcctggactttaataagtatttgaaggttctcaatttgatcagaagaattttgagagctaaattggaaagaaaaaaattaagatgtttcaaaaaagaaatacctaaatatctgtatttataaactactgtaagagtatattaagaactgggtttacaataataaaatatacatggatatacatttatgaagtaagttaccaaagctgtagcgtaagttcatgaaatgaaagggtttctattgttctatttaagtgaatccacctcctccctactaccaccaccattgaagttgttcagttacatgctgacatcttgtggaataatgtgaaaatgcagttatctgcctttgtctgaattttcggttttggcctgcttatggatccagtaatcataaaaacgaagtttttctcttagatttatttatagctctcactcttaaaaaatgatactttcttggcattgtaaaacattttaaatcaagttttaaatatctttaaaaacataaagagaagttgtaaatatgcttatttttttagaaaggccttgatattatcctaaaggcttttagaaagcctttttttttggcatttggttaactttagaatgttctgttacctctaagaccattgtaaatatgtgaattaagtctgttttgtagcccttcttattcatattaagtgactttatagtcttgtctttttatagggcatttagctgtgatattctgaagctcaggatctacttaaggaaacatttggggtgtaccttttaaataatatttagaaaaactgaaacgtttactttttggaaatggaatattttagtaattttgtcatttatggaaaaaaaagcattaacttctttagtttgcactttggcatagttagacatgatctggtctgagaatgatctctgtactatttaaaaactgtattgtcattttaaagcttgggatttaaatatcagtttcatcacatattagctgtaactttacctctttgagtttttttttttctttccttatgtgaaattcagttactcatcaacaaaatgctattgccaccttggtgctaggcccccactttatgttaggtgttcccagggagtcagggagctgggtgctcaccctcgaggagccaggagaaggcatatagaagggatgtagctcagaggtatgtgattgaagcctgaccagggtaccgtaatctacaaaacaggaagtaagcatgagagaggcttcactggggagtcaagctgagatgtgaaaaataaatcagtgttgttcaggtgtcactagagaagagccatctaacctgcagtggaagctttctgacatcacagcccatggtggaggtctgtttggcctgtcattttggtagaaaaattctcatctccagcctggccaagacagtggaacctcatctctgctaaaaatataaaaattggctggacgtggtagcacacacctgtagtccagctacttgagaagctaaggcaggagaatcgcttgaacctgggaggcagtgagccaagattgcgccactgcactccagtttgggtgacagagtgagacttcatctcaaaaaaaaaaaaaaattctaatcaatagccaaaatttaaaaaaaaaattatgccattttattagggagagtaaatagacacacaaagcaattacagaacaagtagaggtgcaagctaagttcaaatactgtggatatgtggtaagttactaagtaacaagagttttttgcatgttgcttccaactggcaactgccagaattctaaagctaaaacatttaatgtgaaagtttgaaccaccgtcttaatgacaaatggatgttggggcatccctcatcttctggcagtaagaggcctgctttccatcagggtagcaattccctggatttgagtaggagccgttccttttgcatggaacatggaccatctactttgctgtaagccatgccccctccttcattctgtctggttgctgtagtttcttgactctcctccaaatcatttaaatatgcaatatgaaactatagggcatgaaattgcctgggggtagcttttgtcatttgttaaacagttacttgatatgtgcctactgtgtgccaggaattactgggtacttgaaatataaattattggacaaaacatacaaagatcactgctcttccagagcttaaattctaaaaataaaagtaaatctaggaagtaattcatataatgtgttagtatgtgatttatcctccaaaagtaataaaaacaacagaacaaggggaattgggaaggagatcccctggcactattaagttgagatggtctggatattattcatttaagcaaagacaagaagaagggcagggagttgagttgtgtgtatatctcaggaaactcagtccaggcagaaagaatagtctgtgaaaaaaccttaagacaggaacttaccttaaggagtgagtgtagctggagtgaagccagcagagggaacggtagtgtgaaatgaggtcagaggggcaatggggcaagattgcatagggccttgtagatagaccatcattagaaatttggatttactctgagtgaaatgggggtttgaagcaaaggcttgaaaatctatactatgttttaaaatgattccttaggctgttgtgttgagaatagactaaaagggagcaaagaaaaatagggagatcatttgggaggttcttgtaatccaggtaagagataatggtggttcagaccagggtatcagcatcggaaagtggagaaatggttggattctggattttgttttgaagttagagccattgagatttcctgatggaaatcatgtaggagaacaaaagaggtcaaaaatgactctgatttttggcctgagaaattggaaggatggtattgctttcaatttcatgatttcaatttaggacatattgagtatgatgtctattggacatttaagtggggatatttgaaatgtttggagagaaaatcaggtcatactaactggccacttaggtgcatagagagacaggggcagagggaaagcaggagtgagccttaagagagattgatagcaaagtttctattctgtgcatgacagggaactgctgaaaggtgaaggaaagatttgagggagtgtaagattggagggtaggtaggagatggtaggtaatttccttgttgatgggagtatataaattggtagagttcttccagagaacagcagcatgtggcaaagtcctgaaagccatgctcttcactggactcagatattcctccaaagagagtaatagcatgaacatgcaaatatttatggttaagttcattgccattttcttacactgaccaaaattagagataatccaaaagaacagaggtggctagttaaatacattatggcatatctatacagcgaaataccatgaaagtgtacaaatgtgtatcttgacattgaagagattcgtaatatgttactatgtgataaaagaagttacgagtcagtgaatggtgtagtgctatatttttagggggtaatagctatgattttaatgctttgcagaggtcagacacaatgctaaacattttacaaatattgtctcgtaatatttatggtagtctaattggggtgtattattgtctaatttttttcagatgaggaaagtgagaattagcaatcttaaagttactaaggttatctagataggaattagtggagctggaatttgaaaccaaatctatatgactttaaatccatggactcttcaccattattctctgtttctccatagatcacagaaggactctaagaaggatatataccaaaactctgggcttatgggtggtaatacaatgaacatggattactgctgttataaaatatgttttatatgtagttcttaaaatggtcctgggctagagccaaggcccagttgagaatcgaaagaagtttagaatgtgagccaataggaaccctgcaacatgtggatactggttggatgtgaagaatgtggaagaagaagggaatctagaatgacttgccaaatttggccttgggtgactttagcatcaagcaaaagggggacagacttaaaagtgagtttttgacactttgggttaacgtgcctgtgtgagtcggctacaggggcctgaatttcaaggagcatccagcattggaggcacacctttgggattagcctagagattgttgttgaagtcatagagtggttcatattacacaaggtggatatatggagtaagaaaataaagagacaaagagagatctctaggggattccaatgtttaagtatgggccattcaagaagagctggtgaaggaggctaggaaataataggaagtaagagaaagttgaaggatgtatattttctctgaagcccaggcaggaagagtaaagtaagtaaaaagagcttggttagtagtgccaaatgctgcagagagactgagtaaggttaacactgaacaaaggtttttgaatttgaaggttaattattactttccccaaagcattgtcaatggtaatttatggaaaaagctagattgccagggattggagagtgaaagagactatagatcataaacattcttcaaggtaatatttttaagaggctttgactcaatgcagtggcatgcacctgtagtcccagctacttgggaggctgaacaggaggatcacttgagcctaagagttagatgccagcctgggtaaaacagtgacacccctgttaaaaaaataataattttgtatgctattaaaactaaccgtttataattgggcatttgtattattaagacgtgctagactacactagttaattaataatttgagccaggttttaagatgtactcaatttacctcatgaggcaaatgtttttagtgactacagcatactgagtgtttggtccaaatgtagatgttcttaaatactagtatgtcttatccattaattatagtaggaagaaacagttggaggaaaaataagaaaattgtagaccattaataataatcattttctgataggctttaacttgtcgggattgataacacacacatctacacccacacatacacctcagaagtcatgtggcctgaggatatagccccagctctgccacgagtgagtgtgacaagtcattttacctctgtgggcttcagtttcttttataaaatgatagggtaggatcaggttaatggtgtttaaccagaagttcacaatagtggcatctgtaatatttaattttttaaaggtttgtttatttttggagataaggtcttgctttttcacccaggctgaagtgcaatggtgcaatcatggctcattgtaacctcaaagttgcaggctcaagggatcctcccacctcagcctcatgagtagctgggactacaggcatgcatcaccatgcctggttaatttttaaactattttgtagagacagggtcttgctacgttacacaggctggtctcgaactcctggcatgaagcgatcctccctcctcagcctttcacacctgagattacaggtgtaagccactgcacctggcctggtaatattattttagaacaaaacaaaaagcaaaccgtgattgggtgactcgctagacccactgagtcagactctcccagggcaggacttgggcgtgtgtatcgtctaaaagctggaagggtaattccctcttcctattggtgtgtttgtgtgtgtgtatgcatatgtatatttaattttatcatgaaactttttaaacacatacgagtagaaagaatagtacatgagccccccaaaacctttatcatcaacaatcgaacacatttttctgatcttgttgcatcctgtctcccacatgttttttccttttagaattttaaaggatatcttataattacctcagattgcatctctgcctactaagaatgtagggggcagctttgatgaacaattggttgtgatttgttgactcatccaggcctcagggttattgtgacttaggtttgtatgatgtttcttctgccattcaagctcacctctcaaagggaggctgttcatttatgagagtgagggtacagagtggctgtatgagattctgtccaaaatgccatgctgctcaccacttctgacctcataggtcaaggaaacaaaaggctttctctcatagggttaatgttagtgttaacttgggacatgctagtatcacacccttaatttaccagggaggaactcaagctttagagagcttacgtgacttgctgaaagttccagaataatgttgtcacattttaaagtgtagggctatggatgtgaaaaagaaatctgttgctaccactggaagaatcctggcattggcagcagtgcggtgtagatgctgagttgtttgtggccagggttgcgtgcctttatgcacaactctgtttagaattgcatctctgatttcatttaacagttcttgctgcaaagcattgttgcaggtattgtttcaagcatctgctttaggtctggaaatagtggctggatttacttggggacccaagtggaaaatcagattacaatatcaagcacaaaatcttatttctttttatgacattccctgatttttaatactgcataaaaataccacattaaaaaaaaatattagaacttatgtcattggaaattaaattcttattaactatggaagttattttaagcctttctttaaaatcctctgaatctgtgagttggataaaagtttaaggcatttggataacaaagatccaattataattagcacatagttcaagatagtagcgaattccttttatatcaccacttcccagtattgtcagttcagactagggtgatgaatataccattttagtttaagataccttgctaaaatgtccctgtttaattttctaaaatatgtgttatatctggccttctttttgaaaaagctgtatttccaatttgcccttttgaagataaaaagggttttctgtagcataaaaaatgtcagctttacatttaaattagcttttaatgaaaaagaaagagacctcttttaccggtctgacattaaatttctaatctctagagtgcaaaaatatgagcaatgcagtgtttttagataccttatgaaaaaatgctaaaattgttatttaaccagataataataaaatcaggtttagaaatataaacttcagttcaatatgtaaaacatgtgaagaccatatgaggtcattttctctattttaataatcttagcatgcataagaaattaacactcttgaagttgtaaaatcctttgtgacttttctttgatggagtgttagtcaaatactgcccttctccagtcctgctgtacctcacataactgcagttcacaagcacgctcctcccctatctcaatgggaaaaaaaagcaggagacagagtgacaattttagattaaaacatgtgaaagagaagggttataaagatcatactgtgtacagattcagttattattatggctcaagttaagaacagactggcttaacgatcaggcatgttgtatcttttcaaagcttggcaactcaatgtaattagtatagtaataacttcagtattcgatacagcatgattctagtacttaatagtggttttcatacaccatttaaatgatggctttggcataatttattgtttatcatctttgtaaatatcatttggccttccttgtcaagatatccagcaaaaacttcccagaaacaactttaactctttagctttaccattatatatactggttaaactcgtttcttcttcagggataaagagcattgtatatccatattgagtcaaactctcaatctctgtattgttgtaagaatttggatgggatgaatcactacagaaataaacaagctgagaaatgttcatatcccatagacacacaaaccacacacacactctctctccctgccgtagaatacaggttctctagtggtcagagaatgtcagcctaggaaggtttaatgaaaaccatgtaccattgttggtttaatgaaatgctttccaaggatattgatattccagctctttgtgaaatgagtcaaaatgactaccgtttgtagcttgggaagggttcttgctgagctcaaaggtggcttaacctcatcctctgctcattgagggaaagggatgtgggaaatgtttttatttcatagccagaaggaatctgtaggagagtactcatgctgcttcccatcttggcaaaaaccagcctgtgtaccccataatatgtcaattacctaacattacacatatacgtgaaaactcccaattgcccccagaagctagtatcttgggactctctattaaaactcttaactatcagaaagatcctagattcctgggtcagatgtggtgctttctgtgcaagtccttttaccaccctgaactcaacacctcatttcataaggaagcatggcatggtcatactccccaaagctatggtacctgagctcatttagaaagcattaagttgtcactcaatattgagggtcaacttgattggattaaaggatgcaaaatattgttcctgggtgtgtctgtgagggtgttgccaaagaagattaatatttgggtcaatggactgggagaggcttggtgggcaccatctaatcagctgccagcatggctagaataaaagcaggcagaagaaagtggaaagaacagacttgctgagtcctctggccttcatctttttcctggctggatgcttcctgctctggaacattggactccaagttcttcaatgtttggacccttggacttacaccaatggtttaccaggggctgtctgaccttcagccacagactgaaggctgcactgtcagcttccccacttttgaggttttgggactcgaactggcttccttgctcctcagcttgcagatggcctattgtgggacttcaccttgtgatcgtgtgagtcaatactccttaataaactcatctatgctatgagttctgtccttttcaagaaccacgactaatacagatattggtaccgatagagtggggtgctgctataaagatacctgaaaatgtggaagtgattttggaactgggtaacaggcagaggttggaaccgtttggagggctcagaagaagataagaaaatgtgaaagagtttggaactagagacttggaggactcagaagacaggaagacgtgggaaagtttggaacttcctagagactcattgaatggctttgaccaaaatgctgatagtgttgtggacaaaaaagtccatgctgaggtggtcacagatggagatgaggaacttgttggcaactggaataagggtgattcttgctatactttagcaaagaaactggtggcaatttgactctgccctagagatctgtggaactttgaacttgagagagatgatttagggtatctggtggaagaaatttctaagcggcaaagcattgaaggggaagcagaacataaaagtttggaaaatttgcagcctgacaatgtgatagaaaagaaaaacccattttctgggaagaagttcaatcccactgcagaaatttgcagaagtaacaaggagctaaatgttaatcaccaagacaatgggaaaaatgtctacaaggcatgtcagagaccttcaaggcagcccttcccatcacagagggagggctaggagggagaactggtttgctgtgccaggcccagggctcccctgctctacacagcctcaggacatggtgccctgaatcccagctgcttcagctccagccatggctaaaaggggccaaggtacagctcgggccattacttcagagggtgcaaaccccaagcctggcaagtttacatgtggtgtttagtctgtaggtacacagaagtcaagaattgaggtttgggaacctccgcctagattttagaggatgtatagaaatgcctggatgtccaggcaaaatttgctgcaggggcagaaccctcatggagaactgctgctaaggcagtgcagaagggagatgtggggttggagcccccacacagagtccccactgggacactgcctagtggagctataagaggagggccattgtccttcagaccccaggatggtagatctgctgacagctgttgctatgtgcctggaaaggctgcagacactcaacatcagcctgtgaaagcagccgggagggggtctgtaccctgcaaagccacaggggcagagctgcccaaggctgttagagcctacctcttgtatcagcatgacctgaatgtgagacatggagtcaaagaagatcattttagaactttaatatttggttaggctgggcatggtggctcatgcctgttatcccagcactctgggaggccaaggcgggtggatcacttgaggtcaggggttcaagaccagcagccaacatggtgaaaccccatctctatttaaaatacaaaaattaactgggcatggtggcacacacctataatctcagctactcgggaggatgaggcaggagaatcgcttgaacccaggaggcagaggttgtagtgagctgagatcacaccactacactccagcctgggtgaaaaagcaagactccattgcaaaaaaaaaaaaaagatttggtgacttccctgttggatttcggacttgtgtggggcctgtagcccccttgttttggcaagtttctcccatttggaatgggtgcatttgctcaatgcctgtacccccattgtatctgggaagtaactaacttgattttgattttgcaggctcataggtggaagagacttgccttgtctcagatgaggccttggacttggacttttgggtaaatgctggaatgagttaagactttgggggactgttggaaaggcatgattatgttttgaaatgtgaggacatgagattttggaaggctggggatggaatgatatggtttggctgtgtccccacccaaatctcatcttgaattctagttcccataatccccatgtgttgtgggaggcacctggtaggaggtaattgaatcatgggggtggtaacccttatgctgctgttcttgtgatagtgagtgagttctcatgagatctgatggttttataaggggcttttccccctttgcttgacatttctctctcctgctgtcctgtgaagaggtgccttctgccatgattgtaagtttcctgaggcctccctagccatgaggagctatgaatcaattaaacctcttttctttataaattacctagtcttgggtatttcttcatagcagcacgagaagagactaatacattcagctcttcatgagatgtgttggaggggaaaagagactacatccccaagtagatacatgctaatgttagtaactctggcttttctctttggctctctacagaagtaagtgactgaattatctcttgtaacacacttaattccttttctctgctttctttcccttcctgtcttttcttggtagtggagggaataccatatggtggatagaggcaccttaacttgtttcttttagacattgttcctaagatgagtttttgccattaaggaaataccccttggcatactttcttttattctagagacattttactttgtttatgttatcattgttagtaaaaatgaacaaaaaataagtaattttgaatgattcatttaatcaataaacattgatgggtggctacagatatgagtcagatatgtggcatacaaccagaatacaggtcatatagtaggacccttatgaaggagagtcagcggaatgaagagattccttttgactctgtggagcatggaaggttccatggagtttgaggtatttgagctgagccttgaaaatggttagcagagagatatttgggagggggagtagaacgtacacaaagataggaaagcttggagtgctgctgggcctttttatccaaacagtagaaggttctacaagaaatagtgggggaaaaggccaggagctgactaagattgccatatccctgaactctttatggtaatatattattttctcaatcattttggttttgcaactcatttattatggactttctgtatataaaaacttaatccagtcatcttcactttaaatgtcagtgcagatttggctgccttcttctagggctgggtaagatgtgattctgggaacaatttctgtccctgataaacctgtatataaggatatttgacactatgacttaaccaggatttcctaacttttaacctcaatataaagtgcatggctatctgtaaactctagcctgccgttcaagtccctccacaatagtaaataatatttatttactattgttttataagtaaaacaatagtcataataatagtgataaactaacagaatccaaaataccaatattgttgtgcttactgagtagacaaggtggattagggttttatgagcacagtctcagtgcttcagatgttgctattacaattttcagtctaatgttaaaggtgttcatgctactgattattttccacctcctatgaggcaacaaataggtgaggccatgtgaacagcttaaatggccatagtgggaaataacctagagttcaaacccaagggagaagttcatggagtcactgagttgtatgttacaccattgatttaataactgctttgtaccacatgaaatgccccatccattgcaagaagcagcatgtgttccaaagtgttctaagtgaaaataaagcctgtcacagaatcaaggacaaagggaaattatacttgtatcttagggatgaggtcaaggtcatagactgaagtatcaataagtcaaaaaaccaagccaaggattcaggctggatggaaagatgaagcaggaattgaggggtgtgggcacaggttggaattgggggcttggaattgggaggttggaattaggttgtccttcacagattgaattgagcataatatgtcctgcaacagaaggtagaggaggatgctatgaccaaggttagcccagcaaagtcatgagtgtaaggccctggaaggctttgtccatttttgttcaggtttggagtaatgtgttctgtggcccttcactgactggtcagaggaaggaggcaggtggggcaccacccactctgcagcaggatttctgaggttgatggtcaggtcctttgtgatacctttgcaggtctagctgttgtttgcagtctgtggtcttccacaatcccatactcactgtacagtcttatatcgtgttgcttcttttccttgttattcccacactaaatctctgatattactgagaagcaatattaaatcttttagggtacctacatttttatagagcctgattctaaaggtatattatttgtgttgaactttgaaagaaatcaaattagtggcatctgttgtatatctctgctcaatgtttattttattttatttttatttatttatttatttttgagatggagtctcactctgtctcccaggctggagtgcgtctcagctcactgcaacctctgcctcctgggttcaagcaattctcctacctcagcctcccgagtagctgggattacaggtggggcaccaccacacccagctaatttttgtatttttagtacaaacagggtttcgccatgttggccaggctagtctcaaactcctgagatgtttattttttaaaaaaacaattcaagaccatgtacattaaaaaaaaaaaaaaaaggacatgatattgtgggcacaaagttatgcagtaaaggacttatttcttatttattactgggtaagtaaacctagtacaatatctggtactcagtagatgcttaataaattttggttcaattgaacagggtatttgtattatttaaagcattatcttttgaacatgatttgtgcgtgctgtttattctaaggtctaagtcataatggttataaataatagtatttattttagcaaaaccctttaggaattaattaagactaatatttctaacgctatagctgacattttggtattacaaacctcataaactttcactggtatcctcgaatccataaaatgtttttcacatccatgggcaaaagatttagaaaggggtcatcgtaagttcaaagtgtatagccaaaaagcatgagctcattaaccaaatggggaacagacaataaaaatagaaaagtatgtttcttttttataaaacattcagagacaaaaaaattttgtgaaattttgtgaatgtccaggaagatttttcaaatgtacatactgcagtagcacacagagtaacttctttctgattcaatttcataaattgctacatgaagaagcaccctctagtagataatactcagaaatcagcacttaatatggcagtaatggttattgctgtcattctttacatctttaaaaataattaagcattactgcacaggcattataaagttcccctatcaccattaagaggatatttgaggtttgatgtaattttgcaaattacattatacagtagttaaggtttttatgtagtgaagtaaaatgcgtagtagttaagcacacttactatataatgcattgtagagttacacgttccagctgctgccagctttgttccagtgtcattattgctttgcaggctgacgttcctcagggagtgattcgagtgcaagctccccatctttcgaaagtttccatggcaatacagctaactgaagaactaaaagccagtgatgtacttgccaggtttctcagccaagaaaggtagaggcctgttttgtgttaattatgccatggcataagtcacttgctctctctctctcgccttcgctgctgcttcttcttccttttttttttttttgttttaattgtggggtagtatgaaatgcttaaaaatattgtcttcccagcagaagagaacagcagacttaaccattagactgttggaatgagtttagttcatttgatgtggcttgtgttcagattgagcctgattcaagcaggatttctgagtgttccttcactgggcctgtgatgggcttgccaagcgagaccactcagtattctttccaggatatgttgattggaggttaattactgtttgtaggctgtaaggaaaattactaattaggatgcagtggcattaaaataaagaaaagacacaactttttctatgaaatataatggatttcaaaatggtcaaatttaaaaacaaaccataaagaattgaaagaggaaaaccaggcctttgagcgctgaagtctcaaggggagaacataccatcctcattaaggacaacaggtccttcatctatattttggggttgatggggcagggagagtcatttgaaagctgctagcatccctctcactatattagagtatgccctttccagaacactttgcagtgtcttcttatattttagagatcctaacaagtatattgtattttcaggttttgccctttgaattctttcttttagctgaagtcatgttttcatgcctcctccagcctcattttcagtcactgaaataaactaaatgtttaaaaacagagggacatccagggcattggcatctcagtttacgaatactctgtcttggtctttcattgaatttaatctcctcattctaacatttgggggcttcaatcaagctttctgctaaagcacaaggccttaaacagaacagaaacatgttaaatacttctagtaccataattggaaggggaggtataaacatatattttaaagtaccttcccatagggtttataaattgggagaaaggatgaatctgtgcagctaacagatggtgatgaaatgagagagaggcttattggtaatatctaggcttcaataagccagtgtaaacttccctcagaacagcactctgaagtaagtgctattattacgtctgcttcactgataagaaaacagagatttacaaggtcacacatttttcataggtggtagagctggaattctaaatctgtggtttccctccaaaggtagtcccttaaccattctccacactggctggaggatctacagagcatcatagatctgggaaccactagtgcagagactgagagtagatgtgtttttggagattatgtcctgagggcacttggaagatctcagatgtctttgctccctatagtgtcttgcagtttctgcaaagtcaatccacatcctctctgctccctaccttgacttagtagatactaacttttgccattcttcccaccagccatgctctcattctctcccagaacgtgtacctgaagacctggccagacttcagatataagcagctctttccagccagacacagttaatttacatttactttcaggacccaagtgctcaatttagtctgtacttttgttcctctacttgctaataatatgagactatgaagctgtaccccacattcaactgtgactttaatatttaaggtatagcatgaaaacaatcatagtcatattgttatagaaagcaccaacttgtgacaactatcgtctgacaaatttggattttctgcttgtggtgtttgtattaaataagcatttgctacccccagagcagggtatcttcatcccgctcttcctcctattccttctccacctagatggaagtctggtaaacttctccatttacctcacttccgcccccagtcctcagcccctttccttatgcttggggatgtaatctggatttcaaagctaactatttctgtttcaccttcagttagtttttatcatctctttaagtatcaagttcctcatttgtaagaatggaccagaatagcatctattattgtaattaactaggaaaatgaccatgcagcatatagcactgtctgtctgggccgcatagtaagtgaaattctgagtaaatgtttatatatttcttccaccacattcctgtgcttcttccatttgtattccacctgtgctggggcaggtagaaactctatatccttccattctttttctcccccacctcgtcaactgaagccaatggacatatgaatgatatacaatatatgtataataaatcgcacgttcattcattctttggtaaaggattgttgcctttaacgatgaatttgttgattagcattacgcaaaaatctgaatataccaggaaatctagttcctgtttctttaaagtagaacacaggtacttgagaatcagtctgacagcaatatctaactagatgtttttctttaaatcaagtctcctgaaacattcaatttggttttcacagaaatagggactctctttagacctatagtagttgattgtgttatgtactagattaaaaacaaaaataataatgattaaattatttaatttaaaagataaacctacactgtagttggaaacaaagtggatcagatgcagtgcagcaggtggaacatagcgtgagggcccagagagccctgactgtccagtgtgccagggacacagggcagggagagaaaggaggagaaccagatgagccattccatgggtggtgaggagcgctgctgctgtaccatgctcttcctaatggcttgaatacaagtcagacctgattttctcttctcagttccagagagtgtgtcttcagggccttatcttagtggtccactaaccttgccatgcttcagaatccactatagagcatttgaaaagcagtttcttgggctttatcctagaccagttaaatctgagtttctagagctctccatctgaatttttagcaggtttctcaggtaattcttttacagaaagataatgacataatttgcttccactctgagggtctgtgctgccctcatttgcacaactgacagaagagaatggcttattcttttttttttctttttggagacaggatctcattctgtcacccaggctggagtgcagtggcacaatctcagctcactgcaacatccatctcctgggctcaagcagtcctcccacctcagcctcccgagtagctaggatcacagacactcaccaccatgcacggctaaattttttgtattttgggtagaaatggggttttgccatgttgcccagactgggctcaagcgatctacctgctttggcctcccaaagtgctgggattacaggcatgagccttcacacccagtcagaagcatgtcttattcttcacatgcatcttgcacactactggagttgtcagcacagcaaacccatgataaatacttattgaataagagtaatgtgaaaactaaagtggaaacatttaatagttttatgaggaccattttggcttgtatacaaagtggataatcatattaataatttgattggcagcggaaatgttacattaacttttcttttgaattttacaaatttagatactggtttactactttgccttcagatgtataattccatttgtttattttaatttacaggtgtgatacttttattacctattgggtacatttaacagatgggaaaatacaaacgtgtagataattacagtgtgtctaagttatgaattttccataccagccagaattccccaagcacgttaaagtgatttacttgcaagctgtttgatgatacaactaatcggtttgttttgtccctcatagtggggttgcccagactctcaagaaaggagaagtttttttgtatgaaattggaggaaatattggtaagcacttttttttctctttacattttatatgctgttttgatattgccagtggttattatttatgtctttggaggaagaacaggaaattagaagtaaaatataccatgctttagataagttgctgaatattgtggatttctttaatggtttgacctttctcttcaggctctgtttgagcgcctgtacaaatgcccatctatgttcaatttcagcaaaggcaagttccctatacagtaagaataactcctggaatggttaatgatgcaagtttttcaaaactctcttctttgtaatatactcatgtcacatagtaaaggaagtagttgagcttatataaggctaagataacactttattatagtacagtattagatatttttagtaaaagcagatttacttttgccatagttgatttcctgctaaattttatacacatgcacacacactcaaattcacattagtaatttaaaaaatggaatgaattaactttgaccatgttttatattttacccttttgtaattatcagtgagtcttaaccatctctttttaaaaatttaaaataatctttttttcttttttgactcttggaaatggtaagggtaaaattattaagaaataaatgaaatcatgttaagttcaaaatagtaattaaaaataattttgcaataaattttgtagggtgtttttgtgggaattaaaaatgttagtaaatattaaaagttaaatataggaatgtgaaggtttattcttaaataggccatgacactagaaacctggaattgttaactctattagtaaaggttatttaaatattaatagatttgatttcttattttccttttagatcttgggaattaagtgtagtttcttaggtggattcaaaaccattgcccctcctaataagatgattaagcttttaaggaactatttaaaagcctatcatacaaagtattttcagcttcctaaattaatttgaaacctattcatttggagaaagactaccaaatttatttttccaattgttggccaattcttacaatattttgagaaacaggaaagaatgagaagttttttttttattattattatttgttttgttttggagacagtgtctgcctctgtcacccaggctgaagtgcagtggcgcaatctcagctcactgcaacctccacctcctgagctcaagccatcctcccacctcagccccctgagtagctgggactacaggtgcaagccaccatgcctagctaatttttgtattttttgtagagatggggtttcattatgttgcccaggctggcctcaaactcctgatctcaaccaatctgcccacctcggcctcccaaagtagaataagtattttgaagtccaagacttaagagttaaataattaagcttaagtttaaaattgcataccaatctacctgctgtattaaactgacacaacatctattttaacaggggaacgctgccttgatgatgacacttacatgaaggatttatatcagcttaacccaaatgctgagtgggttataaagtcaaagccattgtagaagacttaacaagctgcagataaccatgtggacttctgtcataattcttgctgagtcaagagtgtaaataaaagaaatggcaggactcatattattcagttgtacccaagtatttaaaaatgactctcttaagccttaaaaagtcatagatttgtgctgctgccagaattatattaattattattaatgttattattagaaaaaaaatttctggagtgagagtaaagaggcttaattagtttgtgggcagttttcatatgctctgtgaaatgtgtccagatgtgacatagtttttttttttaatatgtggaaatgtcttctcttcccattcttttctcctaaaatcatatatactgtaatatatgctctctcacctctattacctcctcacatctaccctttcccagttaggtttgctttttgaccaaaaagataacaaataccaggtatggcaagttgtgaagacagcacattaaaacatacctaatttcacagtattcctgtcacgacagaatgttagtattcatctctttgaatcatttgctcaaataataacattccaccttttcctgctgtatcacaggaagtgatttgcattttttttcagttcatctgacttatgttcacagaaccgtatcagcgaccaagaaaataggactgtcagaagctgccagttattactgaaccattaaatacttatatactaagaataaataaaatatacccatgtgaaataataattggattatggataacaagagagtgaaagccaaagcactttctgtctactgtactcttctaaatggaattttaaaagtcatagctggctttacgtgttgtcattattagcattataaatatgcatgatagtataatccagtaatggttgaagaatgtattttacttaaagagggatttttttttttaagtcctgaataagtctactggaagaattattcttctgggtgaaaaagcttttgtttgtgttcttattttaaataatcggagtcaatttattaaaatgttcttgaaagtactattcccagggattttaatgcacaaaccatattgtgacaagagatgagcctctgtactgtaaataagaaatgaagtagagaaatgttaaatattttatgagtttagaatatagtaaataaaaggtgatgtaaatgaatgctgcacaaacggtgttcatgatacttttagtagtactttaggaaaaactacacattctcagaagctcttgatgtctctaatgaagggggggaatgctgttaatgagaacagtcataaatttttagcatataattacaagaacagcctgtggatatgatcacttaaatgattttgtggtgattcgtgccattgcttttttatttaaaagaaaattttgtaattaaatgcctttttctaaattatcttctcttggaatcattacttttaatcctatgtgtttatgagtatttttgctttttttttattaatattgagaaatggacttttttgttattaaaagtcacctctattttctattttctttgtaatttttaaagtaggaagatgtcagagatgtaaatatgttttcgtctttagtttttttccttttacaaatttttattcttcaggattttcaaaatacagtttagtctgtttctttgacaatatgtattaatttcccaattagcaaaatggtacttattagtgggttgaaaacaattaataatataaaagaaaaattaagtgcttaaaacattttaggagtatacaacttcaaaaaaaaagatagcagtgaggataatgatttaagtaaaaggttgtctgaagcatatgccaactaaatttcgcaacgtttgctacctacctgaaaaggagggtcaggagggagacacaacatatttttgatcatgaaaaagtatcttaattttaaaaaagtgaaaatgccattttattttgaatcccttttagaactcacgacccaagttcatcaatgttgaataatatcacgtttaaataacaaaaaaatatggactttaaaaaatctcaaattttttagagacagggtcttgctctgttttccagattggagtacagcagtgcattcgcggctaactgcagcctcaagcactggggctcaagcaaacctcctgcctcagcctcgtgagtagctaggaccacaggtgcatgccaccatgcctggctctaaagagaaaaaaaacttgataccatagagccttgaatataaatatcctgatgttaacctactgcttttgctgtgattttttttccttagtgagttttaaatctcaggctagatttttatttgtttttctgtgtgtgtatgagacaaaataaaaataaatatatttgccttgagtttaaaacatttgaattcttaaaggaggactggttgtcctggtaacgttggtgatgctcttttctgaaagaggcttcattaatctgttctcacactgctaggaagaaatacctgagactgggtgagttataaagaggtttaattgacttacatggctggggaggcctcaggaaacttacagtcatggcagaagggtaagcaaacatgtccttcacatggtgccaggaaggagaaggatgagaagcacagggtgaagcggggaaaagcccctcacaaaaccattagatcttgtgagaactcacaatcacaagaacagcacggggaactgcccccatgattcagtcacttcccacaagatccttcccccaacatatggggattacaattcagattacaattcaagataagattcgggtggagacacagagccagactgtatcagaggtcattgtaattctttgcacttacacaatctttgcttaatgctgctgtaggattcgatgtaaattccttactagtactctctgggaaaggcagattattttaccgacttcaaggaatttttcattattgtctgtcttcgttttcattaaactggtttggactctccatctgattgtcctgatttctcacctactcatcagtaggtggcagtattggtcaggcattcctttgaatcgaaactacgggaagtttttaaaatgaacccgagttcatagggaagttgctaagactcagtgccaggcatctgcaaggcagctaggtaagaacactgtggagctcttgctttgattaccgattctgaaattgtaaataatttcagagtttctatgttcaatctgtttgtctgcttttatccttaatccattgaatgggaagggcggtagaagaggacatttttctaagctgaaattaggcttttcacaacgtccatttcaagcagaacgattatgacaagaaggaaggcagtgaaccgggaaagtaagtgaagggatgtctaagataagaaggcataattaactttttttttttttaatatagtttaagttctgggatacatgtgcagaacgtgcaggtttgttacacaggtatatatgtgccatggtgttttgctgcacccatcaacctgtcatatacattaggtatttctcctaatgctatcccttccctagccccccaacctctgacaggcgctggtgtgtgatgttccactccctgtctccatgtgttctcgttattcaattcccacttacgagtgagaacatgcggtgtttggttttctgttcctgtgttagtttgctgagaatgatggttttcagctttatccatgtccctgcaaaggacatgaactcatccttttttatggctgcatagtattccatggtgtatatgtgccacattttctttatccagtctatcattgatgggcatttgtgttggttccaagtctttgctattgtgaacagtgctgcagtaaacacacgtgtgcatgtgtctttatagtagaatggtttataatcctttgggcatatagccagtaacgggattgctgggtcaaatggtatttctgcttccagatccttgaggaatcaccacaccgtcttccacaatggttgaactaatttacactcccaccaacagtgtaaagtgttcctatttctccacatcctctctagcatctgttgttccctgacttcttaacgatcaccattctaactggcatgagatggtatctcattgtggttttgatttgcaattctctaatgaccagtgatgatgagctttttttcatgtttgttggctgcataaatgtcttcttttgagaagtgtctgttcatatccttcacccactttttgatggggttgattttttcttgtaaatttgtttaagttccttgaagattctggatgttagccctttgtcagatggatagactgcaaaaattttctcccattctgtaggttgtctgtttactctgatggtagtttcttttgctgtgcagaagctctttagtttaattagatcccatttgtccattttggcttttattgccattgcttttggtgttttagtcatgaagtcttcacccatgcctatgtcctaaatggtatttcctaggctttcctctacagtttttatggttttagatcttatatttaagtctttaatccatcgagttaatttttgtataaggtgtaaggtaggcgtccagtttcagttttctgcatatggctagccagttttcccaacgctattaaataaggaaccctttccccattgcttgtttttgtcaggtttgtcaaagatcagatggttgtagatgtgtggcgttatttctgatgcctctgttctgtttcattggtctatatatctgttttggtaccagtaccatgctgttttggttactgtagacttgtagtacagtttgaagtcaggtagcatgacgtctccagctttgttctttttgcttaggattgtcttggctatacgcgctctttgttggtttcatatgaaatttaaattatttttttccaattctgtgaagaaagtcaatgatagcttgatggggatagcattgaatctataaattactttgggcagtatggccattttcacgatattgattcttcctatccgtgagcatgggatgtttttccatttgtttgtgtcctctcttatttctgtgagcagtggtttgtagttgtccttgatgaggtccttcatatcccttgtaagttgtattcctaggtattttattctgtttatagcaattgtgaatgggagttcactcatgatttggctctctgtttgtctattattggtgtataggaatgcttgtgatttttgcacactgattttgtatcctgagactttgttgaagttgcttatcagcttaaggatattttgggctgagatgatggggttttctaaatatacaatcatgtcatctgcaaacagagacaatttgacttcctctcttcctatttaaatacgctttatttctttctcttgcctgattgccctggccagaacttccaatattatgttgaatagggtgatgagagaggacatccttgtcttatgctggttttcaaagggaatgcttccagcttttgcctattcaatatgatattggctgtgggtttctcataaatggctcttattattttgagatatgttccatcaatacctagtttattgagagtttttagcatgaaggtgtgctgaattttatcaaaggccttttctgaatctattgtgataatcatgtggattttgtcattggttctgtttatgtgatggattatgtttattgatttgtggatgttgaagcagacttgcatcccagggatgaagccaacttgatcgtggtggataagctttttgatgtgctgctggattcagtttgccagtattttattgaggactttcacatcgatgttcatcagggtattggcctgaaattttattttgttgttgtgtctctgccaggttttggtattaggatgatgctagcctcataaaatgagttagggaggagtccctctttttctattgtttggaatagtttcagaaggaatagtaccagctcctctttttagctcttgtagaatttggctgtgaatccatctggtactgagctttttttggttggtagcctattaattactgtgtcaatttcagaacttgttattggtctattcagggattcgacttcttcctggtttagtcttgggagggtgcatgtgtccaggaatttatccatttcttctagattttctagtttatttgtgtggaggtgtttacagtattctctgatggtagtttgtatttctgtggaatcagtggtgatatccccttcatcattttttattgtgtctatttgattcttcttttttctttagtagtctggctagtggtctatctattttgttaatcttttcaaaaaaaaaaacagctcctggattcattgatttttgaagggtttttcatgtctctatctctttcagttctgctctgatcttagttatttcttgtcttctgctagcttttgaattttgtttgctcttgcttctctagttcttttaattgtgatggtagggtgtcgattttagatttctcctgttttctccagtgggcatttagtgctataaatttccctctaaacactgctttagctgtgtcccagagattctggtgtgttgtgtcattgttctcattgatttcaaataacttacttatttctgctttaatttcgttatttgcccagtagtcattcaggagcagattgttcagtttccatgtagttgtgtggttttgagtgagtttcttaatcctgagttctaatttgattgcactgtagtctgagagactattggttatgatttcagttattttgcatttgctgagaagggtcttacttccaattatgtggtcaattttagaataagtgcaatgtgctgagaagaatgtatattctgttgatttagggtggagagctctgtagatgtctattaggtccacttggtccagagctgagttcaagtcctgaatatccttgttaattttctgtctcattgatctaatattgacagtggggtgttaaagtatcccactattattgtgttagagtctaagtctattggtaggtatctaagaacttgctttatgaatctgggtggtcctgtattgtgtacatatatatttaggatggttagctcttcttgttgaattgatccctttactgttatgtaatgcccttctttgcatttatttaaatcctcgttggttcgttttgtcagagactaggattgcaacccctgcttttttttttttttttttttttgctttctatttgcttggtaaatattcctccatccctttattttgagcctgtgtgtgtctttgcatgtgcgatgggtctcctgaatacagcacactgatgggttttgactctttatccaatttgccagtctgtgtcttttaattggggaatttagcccatttacatttaaggttaatattgttatgtatgaatttgatcctgccattatgatgatagctgattattctgcccattcattgatgcagtttcttcatagtgtcaatggtcattaaaatttggtatgttttgcagtggctggtaccagtttttcctttccatattcaggagctcttgtaaggcaggcctggtggtgacaaactctctcagcatttattcgtctgtaaagggttttatttctccttcgcttatgaagcttagtttggctggatatgaaattctgggttgaaaattctttcctttaataatgttgaatattggcacccactctcttctggcttgtatgttttctgcagagagatctgctgttagtctgatgggcttccctttgagggtaacccgacctttctctctggctgcccttaagatttttccttcatttcaaccctggtgagtctgacaattatgtgttctgggttgctcttcttgaggagtatcttcatggcgttctctgtattttctgaatttgaatgttggcctgccttgctaggctggggaagttctgctggataatatcttgaactgtgttttccaacttggttccattctccctgtccctttcaggtataccagtcaaatgtaggttttctttttggtcttttcacatagtcccatatttcttagaggctttgtttgttccttttcatcctttttttctctaatcttgtcttcactctttatttcattaagttgatcttcaatctctgatatcctttcttccacttgatcgattctgctattgatacttgtgtatgcttcatgaagttcttgtgctgtgtttttcagctccgtcaggtcatttatgttcttctttaagttcgttattctagttagcaattcctctaactttttttcaaggttctcgcttccttgcgtggggttaagacatgctcctttagattggaggagtttgtgattacccaccttctgaagcctacttctgtcaattcatcaaactcattctccatccagttttgttcccttgtttgtgaggagttgtgatcctttggaggaaaagaggtgttctggtttttggaattttcagcccttttgtgctgtttttttctcatccttgtggatttatctaccttttgtctttgatgttggtggccttcggatggggtttttgtgtgaacgtcctttttgttgatgttgatgaagctgttcctttctgtttgttagttttccttccagcagtcaggcccctctgctgcaggtctgctgctgttttctggaggtccattccagaccctgtttgcctgggtgtcaccagaagaggctacagaacagcagagattgctgcctgttccttcttctggaagcttcatcccagaggggcacccaccagatgccagccagagctctcttgtatgaggtgtctgtcaacccctgctgggaggtgtctcccagtcaagaggcacaggagtcagggacccacttgaggaggcagtctgtcccttagcagagctagagtgctgtgctgggagatccactgctctctccagagctggcaggcaggaatgtttaagtctgctgaagctgcgcccacagctgccccttcccccaggtgctctgtcccatgggggtgggagttttatagggctactgcctttctgtcagagatgcccagcccagagaggaggaatctagagaggtaggctggctacggtggctttgccgagctgtggtgggcttcacccagttagaacttcccagcagctttgtatacactgtaaggggaaaacagcctactcaagcctcagaaatggcagactcccctcctcccaccaagctcgagcctcccaggtcgacttcagactgctgttctggcagcaagaatttcaagccactgaatcttagcttgctgggctttgtgggggtgaaatccactgagctagaacacttggctccctggcttcagccccctttccaggtgaatgaacggttctgtcttactggcgttccaggcatcactggggtacggaaaaaaaaaaaactgcagctagctcggtgtctgcccaaatagccgcccggttttgtgcttgaaacccaggtccctggtggtgtaggcacctgagggaatctcctggtctgtgggttgtggagaccctgggaaaagcatagtatctgggccggaatgcactgttcctcacggcacagtccctcacagcttaccttggctaggggagggagttccctgaccccttacacttcctgggtgaggcaacgcctcaccctgcttcagctcagcctccatgggctgtaccactgtctaaccagtcccaatgagatgagtagggtacctcagttgaaaatgcagaaatcacctgccttctatgccgatcttgctgggagctgcagacaggagctgttcctatttggccaccttgccagccactgtgaactgtgactttttagtgtatatgtgttcattcaacaaatatttattgggcacctacatatatgccagacatgttctacccttgagatgcatcagtgaacaaagtaacaaaaagcccttacattctagtggagggagactgataatgaaatattaatgagcaaataaaattctatagcatattgaaaggtggtaagtacaatggagacaaaaaagatgagcagagcaaataggacaagatgtggagggatagggtcattgcagcattccacaagaagtctcgttgaataattaacaactaagcaaagactggaagcaagtcttcaaggaacttgccatgtagatacctggaagaatattctatgcaaagaaaacaactagaacaaaggtgcaaagcagatatgtgcctgttaccaaaggttgtgtggctggagtggactcagggccggtgatagtaacagggcagggcagagaagtaacacaatcatggggagtgagatcatggagggctttgtgttagggcgattattgttcaaatcaggacatttctgagagtgaaacagggcactgttggtgagggcagtaactgtggagtgataagtacccagattctagatatatttttgaaggtagagcctgtaggattttttctgatacgagaggatttttaatcaaggataaccataagacttttgacttgagccattgcaaggatggattttccaacaagagaaatagggaagtggaggtaaatcaggtactgttagcagggattcaggagttcagtcatggatgtatgggatttgaagtgcctgttagatatccaagtggcaatattttgtaggcagttacatgagcaggcattaaggagagaagtctgggctggattcatcagcatgcatatggacttttaaaccatgaccttgcatgagatcaccaagggagtgagtctgggtataataaataaagttaccgagaactcggtcctggagctacccaacattagtggttagaaaagaaagaactagcaaagacgttgaaaataagtaaccttatagataactgagagacagtggtgtcccagaagccaactgcagggggcgtgattgtagtatcagatactacttatagttcaaatgagttaaagggcagaagttaaccactggctttacctatgtggaggtcttagtagaccttagtagacttaccagttttggtaaagtgataaggatgcttatagcggggttaagagaatgagaattggggactgtgagtatggacagcacttataaggagctctcctacacacaagggagcaaataaggcactagcagaagaaagagttggaagtgctttacatagggcctttgatgctgggcaaaagagtttttttaattttaagcattttttttttcaaatttaagtaatattttgagaagagatgatatggatactggagccagactacctggattaacgaatgtgatcttggacaagttacttacctgggcctcattttatactttggataaagataataataggaatattcttagcagcttactagaattaaacaaccatacaaagggctcagcagcatacttgcctgatgggatttgataaatgtatttttattacttgttattatgctcaatattatcagagctgtaccttaataattttaaaacatattattctaggcccggcgcagtggctcacgcctttaatcccagcactttgggaggccaacgtgggcggatcacaaggtcaggagatcaagaccatcctggccaacatggtgaaaccccgtctctactaaaaatacaaaaagtagctgagcgtggtggtgtgtgcctgtaatcccagccactcagggggctgaggcaggagaattgcttgaaccagggagttggaggttgcagtgagctgagatggcaccagtgcagtctagcctggcaacagagtgagactccgtctaaaaaaatatatatatatatatatatatacatatatatataaaattctgccatattctatttttctcatcaatacagagaaaagatgtaacagacctatcagtaatagatcctaataaacagatgagagaatggtggaagagtgggcagcacctatatttagaaataaccagccctcccttgaagggtaattctgatagcatcccccatgaacattcctttccccaagttaggagtcatttactggatatttatggaatgtccctcttgatctcatttggagttctggttccagtgccacactatctcacctggaaatcagtgctagtaactcttccttggagtatcggtgccactgtagggcatagaaataattttgtgagaacatcttttttctacttctgtgagctcagctcaactttgaatattatttgtttcatttaagttaaataaactggcataaagacagagttctctccctgcatttcagaccagaaggtctaggaagtaaaactcttatccagttcattttctgtcttgatacattgttcactcttgggacaatcctgggctctttcagttggcgttagctgctcctgctggcagaagttccaattccttgccctggtgtttctgggtctgtgatctctcaaatgttgtatttaatacatattaagtggcaataataatttccctcccatttcacttggcctcatatcttggaatctggacttggcatccagcttctctttttcacttgtgtcctaaagttgtgtatgcagtcggttggctctggtagaaaggattccagatgaaacattagaaccccctccttccatacaagcatttcttcaagtccttaaggtttcttggaagagtttcatgagttattttcacatgtagctgcatactgtatagagaaatagattggttgcaagaaaaactgcttctatggtacttccaacttagtcaagaaacactggctttgtcacaagcaagctttttatcttgagattgcaagtcttgatttctcaactgaaggagctcagataagctacagagaaagcagctccactctgtgctatctttactcctcttttgatgttctcctctcgctgcacctgggtagctcagcgctgcctcttgttgcatctcctgtaacctttacaaaataacagctttcgtgtaatctctgctgcaagtcaccttcccctccagcaagggccaaagtgaacaaggaatttcccctggagggaagttcgtaaggagagtcacagacagtggcccaattctgagcagtcaatcagttacatttttctttcacctgagtgtagctttgttacaatcacaaaaagggagtgatttaatcattacttgtgccttcacaactctcatttcaatggggaaaatcttggggtgtcttagctttggttgcttgtatcacccagtttgtattgttgactaaacaaatactagatgtttaaagaattaaaatttatttagagtcttattgaggattatattttggaaaaattgtctagagatacgttttgttagacttttttaatgcagcttaaattatagtttttatgtagggagtgaagatccagcatgtataaaattatattaaaatttgggcctaagagtatatttggttatagtttgcgggggcataattgttgattttggcaggcatgattttatgtgtaagaacaggtaaggaccaagttcatttattttttaaggaatgtaatgtcttaggcaagagatgtggggagctgtgtgccctatcttgtttatgtctttaaggcattattttggagatccatacttagtaacagaatcagggagactaaaattatgttggcaagtaaacatgacttcttatatttgttacttttttgtcaaatatttggaaaaaacaaaaggagttttactgagaacatgaagaattaaataagagattgtgcatctccacttgtcgaagaatcctgaaacatgttctaggacgtgcttcattcatcctcatgctaattatgatattaagaagagggaaggagccgggcatggtggctcatgcctgtaatctcagcactttggaaggctgaggtgggtagatcgctggaggtcaggagttcaagaccaacctggccaatatggtgaaaccccatctctactaaaaatacaaaaattagctgggcatagtggtgtgcacctgtaatcccagctacttgggaggctgaggcaggagaattgcttgaacctgggaggcggaagttgcagtgagccgagactgcaccattgcactccagtctgggcgacaagagtgaaacttagtctcaaaaaaaattaaaaatacaaaaaaaaaaggaattaagattctttattcttaagaaactgttaggtgtaactagataatacatcaaagtataccgagttcattagacaatgttattttgataaggaatactctaaattttctgaaagaaaaatggctatccatttgtttttcttagcattttagtgcctgctatgtgctataccacaagttaggttgcgatgatgtaaaaatcaattgtatgtgcatttccacaaggagattggatttagatttgtgaataggattaatggggaatgtatccctagcaaatgggctttgatttgagggaagcagaatatgggtacaactgattgtatgggtaaaatgtaatgggaagatagagaaaggacactgttagttgggtaattgttaatggagatagtggtacttaagctggaagtgcagttagaatattgaagactagatcaggtcagaaatgatgaggctcagaattagggttgtggcagtgaaaagtgagaacggggcagacagatgttgcagaatgaggtcaaaaggatttgatgattccattggatggagagaagtgagggagcggagtttaaagacgtttagaagatgatggtgcttttcactgactcccagaactgggagaagtactgatttgaaatgaagggattggggcaagagaggggtaagtattatgggtgtgaaaggagagaagatgaggatatgttgagcttacagtgttgaagaagctgaacagttagaactgagacatcttttaggtaagatttctttgaaaatgtatatttagaaaatactttgcagggtggtgatatttaaagccatagaagcaaaacaaatggtccattgagagcgaagggccaagagagggctaagaacaactttgaggaatgcctttctccacttacaggatgcataaagggagagataccttagaaggaacagttcaaaccatagtagtagtgtcagaagagtaaaaatcacagatgtcagggttgacagcaggtttaacaaaaaggaaatgatcaactatgtcaaataattgagagaagtgaaccagatgaaagttaagtagaaaccactggagctgaagtctataagttcagggctgacctagagagcaggtctagagtattttggagtgatgggaacagatgcctattgccataagccaacatgtaaataggaattgggaactatgaatttagttgggattgttgggggaaaaggcagaggaataaggtttctcaaggctttttttccccagttggatattttgcagagggaaacttgatcataaaatagttttcacatctaatttctaatatctgaactatctgtatttctatttttagttaattcaagagcttcttggttcctcttatctaaaatattacaatgattaacttttgaagaaaactgactgtgctaaagtatctaaaagatcactcagagtaacttctgaagaaaattgggttaaaggtgaaaaagcctccttctccaagaattttgccagtccttaaggaagaccagtaatttaaattttctttttatgatttttaccttgaagaaacttttccacatttaaatcaaatgattttaaattaagcgtgtttgggagctggtgttaaagaagggctgataactctgagacactaaagcttgttccatattagcagcttttttgaaaatatccttggttgggagctgctaccctgattctcactccacatataataagagttttgctctgcctactataatttatatagcaaaacccaaggaacatatactagatgcattgaaaaatatgacgccctgtaaaacaagacttaggacaagtgttacagaaggctttgattccaaatcctaattattggatggcaaacaatacaccaagtacactataataatgttcttcaaagttttccacttacatgtcccctaaagtgattattacaaggatgtattatcttgaatatttttttcattaaaatctaacatttttcatcctaagtttaaataattgcaaaggacattctaatactttaaattatttcaagaataacatcaataccatagtgatttgataccctgttgtctgtttttaaaaatgcatggaagctcatcattaatagcaagaacttctacgttttttccccttgaactcctatttttattagactttcttccttagaagtttatcctaaagtaatgtattcaatgatacaaagcaattgtgtttctctacagcaaaataagtatatatgttgaagttattgttgatgaaacaaaaatatatcacatattttgataaagctaataaaacatttaagttttattgaaaattaggttctgagaaagggtttcagtttttaaaaaatttagttatcactggatagatgttattcctaataaattcagcatcaatttagtcctctttctcaattatatgtgtgtagacaccaagaaactttttcacaatcaaatgtaaattgcaattattttagtgatactcagagatactcagttttttgaatttttaaaaagttcattatatgccaaaaaaaaaaaacatagatctctgtctcaaaattattaggtccttctttgtattttttgaaacaatctgacttatataaggatttattacccagctgttacaatcattcattttttaatttctgagaagtatgccagaaaatgattactggcttgatgaggagaaaaatctgtaaagctcttgttgcatatattgtcaaattgctttttaggaaagtcatactaatttatacttccatcaatgacagttgagtgataatctcaatgtcttctcaccatcattttctttaatattcattaatttcatgggtgaagaaatgacattttgctgttttaatttgcatttcatggataactaatgaggctaataatgtctcatatgtttgttagtgaattcataaaaccaggggagatatctttttatattatttgtttctctgttacagtactagttatatatactctataacaaatatataaactgtatatttaggacccttagatttatcatatttgcacattgaatgagtatgtataatagagaatagaaatgttatagaagagcacctggcccgcagtaaataatgtataagtcaaccaaactcagcagcattgttattacaatgataaatatttcttccaatttgactttaaatgtttttattttaacataatgctgccttttttttttgccttggtgttccagagttcttctgagctgagagattattattcaataaagaaggtgttatgaactgtttttatttccccaatattcatttgttaatttggaaatgagggctttgggagataattagggttaggtgaggttataagggtgggtctcttaggactagtggcttttctttttaatatgcaagatttcatcatgaattagtggccttatgatgggaagaaagagagatctcccttcttcttaatgtgtatgcatcaaggaggaaaggtaaagtaagaaggcagctgtctgcaagccagggaaagagtcctcaccaggaactgaattatccagcacctttatctcatgcttcctagtctccacaactgtgaggatcaatttctgttgtttaaatcatccatttggcattctgttatggtagcctgagatgattactatagaaggcttccttagaaattatgaactatttgtccttggaaagttggtatagttacaaataatgttgatcctcatcctctccttgaacatgttgatttatgcataggaattactaggcaaatagaattttcttttagccatttttaacttgagatttcatatcagttttttttccctaagaagttaaatgatatttaaaaatggtctatttatgtcaaaatatatacacataaacctttttttccattcaagtttgttttatttatttttttgtttctgtttttttgttttgttttttttttaatttaattttattattattatactttaagttttagggtacatgtgcacaatgtgcaggtttgttacatatgtatacatgtgccatgttgttgtgctgcacccattaactcgtcatttagcattaggtatatctcctaatgctatccctcccccatcccccgaccccacaacagtccccagagtgtgatgttccccttcctgtgtccatgtgttctcattgttcaattcccaccagtgagtgagaacatgcggtgtatggttttttgtccttgcgatagtttgctgagaatgatggtttccagtttcatccatgtccctacaaaggacatgaactcttcattttttatggctgcatagtattccatggtgtatatgtgccacatttacttaatccagtctatcattgttggacatttgggttggttccaagtctttgctattgtgaatagtgccgcaataaacatatgtgtgcatgtgtctttatagcagcatgatttataatcctttgggtatatacccagtaatgggatggctgggtcaaatggtatttctagttctagatccctgaggaatggccacactgacttccacaatggttgaactagtttacagtcccgccaacagtgtaaaagtgttcctatttctccacatcctctccagcacctgttgtttcctgactttttaatgatcgccattctaactggtgtgagatggtatctcattgtggttttgatttgcatttcgctgatggccagtgataatgagcattttttcatctatttttgggctgcataaatatcttcttttgagaagtgtctgttcatatgctttgcccactttttgatagggttgtttgtttttttcttgtaaatttgtttgagttcattgtagattctggatattagccctttgtcagatgagtaggttgcaaatactttctcccattttgtaggttgcctgttcactctgctgatagtttcctttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaagatttaagtctttaaccatcttgaattaatttttgtataaggtgtaaggaagggatccagtttcagctttctacatatggccagccagttttcccagcaccatttattaaatagggaatcctttccccatctcttgtttttgtcaggtttgtcaaagatcagatggttgtagatatgtggcattatttctgagagctctgttctgttccattgatctatatctctgttttggtaccagtaccatgctgttttggttactgtagccttgtagtatagtttgaagtcaggtagcatgatgcctccagctttgttcttttggcttaggattgacttggcgatgtgggctcttttttggtttcatatgaactttaaagtagttttttccaattctgtgaagaaagtcattggtagcttgatgggggtggcgttgaatctataaattaccttgggcagtatggccattttcacgatattgattcttcctacccctgggcatggaatgttcttccatttgtttgtatcctcttttatttcattgagcagtggtttgtagttctccttcaagaggtccttcacatcccttgtaagttggattcctaggtattttattctctttgaagtgattgtatacacataaacttatggacacatgagtgatagtcaaatttcaatcactaatgtggcatgagcactgacccaccagaatggccatggtaattcaccatggagcagtattgcatcatcctgagtgagagtgaagaagaattgaggtagagggaaactgatagatgtgtttgagattttaaaattatttctcaaacttttacaccaaaatatatcctggtacatgtgcaacttctatggctctgtcagactcatttaataggaaactacccacagaagaaaataaggaaaacgaattctgtaggtagagaaatgtaatgactaagattttaaatgttatgactaagatacatgtttagttgataaaaattaataaaaataagaaactttccttcctagggcagcataagatcatttcagaatgaagatgctttgggatctgacttcggactgtaagaatgacaaactctgaatgggtgcaaaggtagcagatgaccttcaaaggatggtaagtacaaagccatcgatttgggagaaacacaaaatttcaaacacaaaatgtgttaccctgagtctgaacctagaagagaagcttggtggataacatataaattgttacataaagacaaagactcagtgacctgttgtggacaaaaagaaaactgagcatctaggcttatttaaaaagatgctaaaaacgagcagagactgtgctgtatagagctatggtaaagcaacccatacgtatcccatctggatacaataaatgagataatttacacaaaatactttgtaaattgtacccatcatttgtgaatgttagttatgatgacagcagtggccctgatgctgttgtaatagaaccagagcaagagtagggctgacagtggtggcctgagggatgctgtcaactggaaaagatgctgctgcttcagctggaaaatctgaaatcattgcaaaccatggaattgtgtaaatttttgaattagtgaacacgaggtgaacattaagagttaaagtagataatgcattcaggaatgagatggttggcaccttgagaacagggtctttttttttctcatcaggtgtctccaatgtttaaaagccagtaattcgcacataataggtgctcagtggatatttgtggctaatacactcctagaacttacccacatgtgatagataggattctaaagggattcaaagaagacaagcaaatctagcaaccacagaggcaagtctagcatccacagataggtaggattctaaagggatttgaaaaactcaggcaagtctagcaaccaaagagggattcaaagaagataggcaagtctagcaacctgccaatgctgtgtcttcacgttaggcatttggcaagtctctgtgtcaggtggctggaggcattgtcctggagtggccatttttctatttaattaattgtttttgtacttaggtacaggcattgcatgc

SEQ ID NO: 1775 - DNA, 776271 bp, Homo sapiens
  KIAA0960 gene - 11188661 - 11924931 of chr7; NCBI Entrez Gene ID: 23249; Build 35; sequence includes 20,000 bases upstream of initiation codon and 20,000 bases downstream of termination codon of the gene
ttttcttatcaggagacaagatcgaaacttgaactttcagaagcatactaaaaatgcagggatttatagaagtattcattgaataccttgttacacaatggcttgaaacaaagtatataaaattttacatataattaagatgacagtttaaaaatgctgacaatggaatctccagtaaatgtttgctccaggaaactctaaactcttaactaaaggaacaaaactaaaggaaggtagtttatcttcaagagtgaaagtactgtaatatcaattgtcctatgtgagatatataattaaattttcaagaaccatacattcgtctacttttaaaagtgaaaccaaagaatacatctgaatttttgacatttccttagcagcgtttttattttttaatgaagagtctcaaaactattaatcttgctgagaattccacaattgctgatcaaactccatcttgaggcaggttaactaaatggctcataatcatacacagttagtgacaaagagttgtaatgggtttcatcaaaaaagacttcatgagtgtaagaagagataacttcttttcctataaagcacacttttgatgctaccatcttaaaataccttttcatgaattatacaaagtttatagcattattttaaaccagagagcaattgtatgcccttcagtgataagatttcaaagaaagtcctcatcctgcctgaggaactaggggaagacaatttctattcactgttaaccacaatacacagggtattaaccacaatacacagggtcagacatagtgatataccatgggtatacattggtacataaaatacatatatttcttgcagtttattattttccatctattgaataaagagacaaacttttttttttttaaataataacctgtgctaagtctcttagtcaacagtattcagggtgtataggagtgggaaacttgcttagagtgggtgttttgggagggcctctttggggagttggatttttaagccaaaatttgaaaggaggagaaatcactgagtgaaaataaatgaatgtggcattatataggccaagacaagaaaagaaggaagtcatctacagtgtcagtccctggaaatcagtcagttaagaaccataacagataatcatcagatttagtcacagaaaggctataaactgctttggcaagaacagtttcagttgcatggtagagcagggaattcatattactcagaactgaggaatgagtaaaggtggatggtggtagtgaaagggaagccataaacattgccaatctcaaaaacaatttacttggccaatttcattttttgaacaatctaaatacttaacaacagtggttgtaaaagttaacattgtaagttacaacattgtaaattattacaagggagtattatgcaatcctttaaaatgtgaatgaagagtatttaatgatgcacaaaaatgcttgctaacttgtaaatttaaaagcagaatgtaaaactgcatttgcaaaaatctttttaaagtacacgtgacaataacacatttgctcttggatatatataaatagaaaaatatgtcaacactaagtatcatagttacatattatgtccaatatattgatatatatgtaaatatatataactagaaacgaatatactgaaatataaacaggtgttagctctgtgggtgtcttagtccattttgtgtctctataagaaatacctaaggctgtttaatttataaagaaaaagggcttactgggccacaactctgctggctggaagttttgagactgggtatctggtgagggcctcaggctgcttccactcatggcagaagaaggggagctggcatctacagagatcacacagtgagaaagaaagcaagggagagaggagggaagtgtcaggctctttttaacaagatctagtgggaactaacagagcaaggatgcactcacacctcactccacccagggagggtattcatctattcagaaatgatctattcccatgatccaaccattaggccccacctcccaacactgccacacagatgatcaaatttctacatgagatttggtggggaaaataaaccatttccaaactatagcagtggtatagttttgttggcattgattttttaacagtgtatatatattacttttataattacaatgttaaaattaagcattgtagactaggtgcagtggctcatgcctgtaatcccagcactttgggaggccaaggcaggtggatcacctgaggtcaggagtttgagaccagcccggccaacatggcaaaaccctgtctctactaaaaatacaaaaaattagctggtcgtgatggtgggcagctgtaatcccagctacttgggaggctgaggcaggagaattgcttgaacccaggaggcagaggttgcagggagccaagatttgaatccattgcactccagcctaggcgacagagcaagattctgtctcaaaaataaataaataaaaataaaaataataaaatatcataaactacaaataaaaccagatagactggttcaaatatatgctctggtattcactaatttaacttttgagagttagactgttttcctctgtgaaaggggaactataataactttgtatgctttgcaggaagatcatattacaatgtattgaaactcctctttaaaatataattatgccttcaattatttgatagagatttttaaaaatatataccctcggttagatgtcataaaaagaacaatagggccaggtgcagtgcctcaggcctgtaatcacagtgctttgggaggctgaggtagtcacttgaggtcaggagtttgagactagcctggtcaacatagcaaaaccctgtcttttcctccccaccccccaaaaaacaaaaccaaaaaattatccaggtatggtggcgcacgcctgaaatcccagactcttggaaggctaaggcacgagaatcccttgaacccgggaggctgcgtaggtggcagtaagctaagatagcactactgcactccagcctggcagcctaggcaacagagtgagactctgccaaaaaaaaaaaaaaggaacaatggtataataaattagggaaagacaattgaatttttatgtaagttagtaaaatcattgaacaaggaagtgggtataatagataacagtgagtctatattgccttattttttttggaaaaaaataatttttattagaaaaaaatctttaccttccataatatgcatccttcaaaagtttcttatatttgcaggtatctctagaaagtatcctgtcattattgactaggtgcgtgggtacagaaaccaaatatgatttatttagatgtaaaatctactcataattgtgcttctggaatttgtatggtagaagaactctgaaagattaacacagtaaaatacaaaggcaagttgtaaattgggcacacaaaagtgaaaggtggatattttccatgtgactttataaaaagcagagccaggtcattgtgttatttttattttaaagttaaggtagaagataaagtaacttcttctcttttcatgattaagtttgtgcaggttttgtggtaaaatttatctcttctttaaaagtaatagcaaaagggaataaagtttcctatacctaaggcgagtacagaattctaacacagatgaaatttctcttcatgcaacctccaacataaattcaggttcataaatttcaactttttatttaggtgttctataaaaatgttaatctaagtgaatttagtagatctccatttatttatatcaaaagctctgtataccacatatgtgaattaatgattgttttattataatatgtattactgttaagcaactatgatttctgggcacgtagaagatattggcagacatagtccctacccttaaggtagttgtagtctttgctaacattgatgagaacagtcatataaagaatattcaggcaaataaaatatactgacattaaataagaaattgaaaaataagaacctgaggtttggagcattttagaagagatcagcaaaagacttacagatgcatatgtaaataagttgagaaaagagttattatcttctcctaagctctggaggagagattcagggacttcagggatattttgagtaatggaagcaaagaaatcagagagacctggggggcagatgctttgcatattagatagatattctgtagtatagtaatatttttcatcctctgagagtacatttaattcagttatatgtcaactatcaaaatggagttaaagatgatgtcatcagcaaacaaaagtcaggcatcccataactgcacttgggaagttggcaggaagcaaaatagataaaatatgtggtattacttaaaagcacattctttgatgtcagacaatttcacaactggttcagatacttagagcttattctctaagcctacattttcttatctgcaaaatagagatagcaaatagtccttgcaaatctgctctgttgtactaacagtgatggtctaaggtttgacttgaccattgaggtcatgagactcagtatcttttaaccagcatcaacatttttaggtttaaggagggacaggaagggaatcacagagcatgcatagcaacaacatagcagaggctatgtatcctttgtggcaatgtactgcttttatatgccagtcatttcacatttggaactatatgatcatgagagatggtgctgggcaaccttggcttatgagggcaattagcacagctatccctttagcttttttatttagttaggcacacggttaccttaggtgctcataagtgacaccagtcttcagagaagttgctctttatcaatatattcattacttgcttgagacaataaagtaggtgcttggtccaatacagagttcttggtgagattttcacttatcttctctcttacatcccatttttctatacattttgtggaatatattgctaggaaacttgatcaaaggccaaattcttgggcatcccaaaagctagagggaaagccacatatgtagctattaactcttgccttctagaatcaaccttgtaagattttgtgagaagttaatgaaataatacaattagaatgtttagcccagtgaatggcacatagtgcttaataaatgtcagttaacaactatccttattcataaggttcaacatataagattgatgcttggttttgaggttttatgtgaccatattctgtttaggacataatatctatctatcactgtagttactggcttgctgctactgctattactaaactatgcaactctgtatttttccttggtaacacatttggaaacaattttcatattactttctaacaaaaactgaagatatttcattttcctttgtttatattttcatcactgaaggagcacttagatatatatgtaataagtacaatggagaagtaacttggttaagatatcaaaattatgtttaatttgcagcattggatttagttctaagtctccactcaggtaagttactaaagagcttttcctatcttcagcaaattactggcataattgtcaagttttagtgaaattaataaatagaaatggatgtttcatagcattgatttatatatacacttattctttagtattatagctctgtgagcagggcagatggggaggttatagcattttgcattactagtctgcagaggaccatgaaagtagggtaaagatggaaagcaaataaagttcctctgtctgcttttttcagggctgcttttcacgcactgtttcgtgaaatccgtaaagtagagacatatcacatttttggagaatctggggtccactgacccctaggctatattgtttattagatgtcacagcattttgaagaatgttattaggaagaaatttatttttagttttgacattgtttcttgtttttcttcctttccatttctgtcattttcttctgtctaatttgtctcctattcaatccaacaatattaaagctttaaccatttctactaacaagtcatatgagaaagatacaaataagtaaaatttaaaaaatataaaacaacaatacccagccaaaatgttgataattcccctttataatcaatggaattcccctggaattctatcagttcccagatatgttttctcttaagaatgatgcttcctccctcatgaagagagtacagaagggaatagaaaagattctcttctctattcttcttctttctattttttatttttttttgaaaataatctatgaatttctaaaagacagaagaaagaatgtttttaatatacaagtaaatactgcctttataagtaaatgtgccagaagatcaaccagggcaactctgatgtcttcaatgattttgttcttaaatgatgtgactttttttttttttttttagcaaaagttagactttcagactctcagcaacagataatgcattactttcccagtatgttcatggcataatcaggacataatcacgttgtagcacataaaagcttaatagtaaagcatgctgaaatctcagggtgatttttaaaaaggaggaaataaagatgcagcttgatggaggcaagaaaataaatctagctgcagagctgagtcttgcagtgaatgattacctgcatattatctgaaggacttagagcaaaaagtcatggagcaggtaatggtggctaaatgatagagccctatgcttcacttgggtttagtaatataagaagtctagctggcacaatgtgagaggtagtggcatctttgtctaggtgatctgcccatcagacaagaattctggccagtgattgggattgggatgggggtatacaggtagcactgtccagcactttaagggtgatggaaagagttaaggcaagtcaggacattagaaccaatcaaaggaactgtatatcagagacatgttacttttctatttgagaactggtattgaaatctaagagggagttagaatcacaggtttgaatgtattagctcatacctgcagagaagttggtgtaggctatgactatgcagggcttaacaccatatactgtgtttgtggcttcaagatcagttatagttctaattcccacagaattttaggtagtggagatggcagacaagcacatttagcatctccttcataccgctccatcccacctttccatggaacctcaccttggggatccttggaactcactagcaaaaagcagtattagaaaaagatcagctgaaatatataaataccagtgtgctaacttttcaaacaagcttagcttaaccaattaaattatttcaaaatttgaaatttagccagtaattgtgccagctttttggtgcccagtgtttatttaccaagcagcagagacatcagtccatgatgtgagcactgcagtggttttctatacttgatactcattccatagactcttcactctgattctctcaaatacaaagaatactaagattctcactgcaggaactccagggttccttgttctgacttgcttggaggctacaaagatcatattaatgggtactcttctgaccttgaccggaggcagtgtgttatctaactgagactatcagtttttgcccttgaaaactgctccctgaattgatagagacaagacttaaaaaaattggaggcagattacattttatgcttgataataagcatgacttacatactgcatttgcttaaaacaaagtgagacagcaaggtgggaaggggttcccagagaaactccacccgacctgagcactgggaagaatgcaggctggagtggagccacagaagtttgtgcacttcgcaggggaaaggagccgggctcttcctcttcttgggtggaacccggcattcaatctgccaggtgagaagcactccagcaggaactctcactttgttacgagtccctgattccccttttcttcctttttcactcaataaaacccagccttacttacctttcaaattgtctgcgagcctaatctttggtggtcatgtgacaaaaagcgcatctttagctaaactcaggaaatgtccctcaacaaaagtggaacaggcatttaatggaaaatatttcaagttttaggaaattgtttataattttttatgttagaatgccttttttttcttggtgtgttggggccaagggaaaaccttttctttgttctctgaaggtttgctaaaaatgttgacaagagggagattaataggagaagaggcatacaaatttatttgatcatagatttacatgacacaggagactttagaatgagggcccaatgataggaggaaaattgtctatttttacatttaggtttaacaatgtatggacagccacgtagaaatatgattcaacaaaaagaatatgatctgatgttaacagatggaatggggaaacacagcaaggcctgtctgtataaattcttcttttcctctctggtgtctgtattttttccttctgagtaaggatcaggaccctctctggaatgggggttttatgacctatattcaaataaagttggtcagttaatttctttatggccagtttttacacagaaagaggggtagggagttagagtaatatttttagtatttatggctggctttggtgaaaagggattctagtttctataatgactcaccctggggaagaggtattttaatttttatggctagcccttggggagaatgggactgagagacaggagggcaggtaaaggtcaggaaaaaaacttacttttcaggctgtttctgaggctcttattttggaatattattttctgagttccaacagattcatgtgaagtgctcttcgatagtctatgtcttaatacccaagccttggtgtgagaatcaactggagtgtttatgtaaaaagcagatgcatttgcttaaccatacacctgatcctgaatcactagttgactctgaaataatacacactttagaaataatctagttatggatccaggactctcaagctaacttaactccctgtatcacctgcccctcagactagtcatcactcctaggatcttccgcactgtatgcctgaaacagttcattcaatatttggcaaacatttgttgattgcctcgtgtgtaccggggattctcctaggtaccagtgatttaaaatgaacaatacatatatcttccctaggcaataccattcaggacgtaggcacgggcaaagatttcatgactaaaacaacaaaaacaatggcaacaaagccaaaattgacaaatggggtctaattaaactaaagagtttctgcacagcaaaagaaactatcatcagagtgaacaggcaacccacagaatgggagaaaagttttgcaatctatccatctgaaaaagggttaacatccagaatctacaaggaacttaaacaaatttacaagaaaaaaaacaaacaaccccttctaaaagtgggtgaaggatatgaacagacacttctcaaaagaagacatttatgtggccaacaaacatgaaaaaaagctcatcatcactggtcattagagaaatgcaaatcaaaaccacagtgagataccatctcacaccagttagaacggtgatcattaaaaagtcaggaaacaacagatgctggagaggttgtctagaaataggaaggcttttacactgttggtgggaatgtaaattagttcagccattatggaagatagtgtggcgattcctcaaggatctagaatcagaaataccgtttgacccagcaatcctgttactgggtatatacccaaaggattataaatcattctactctaaagatacatccacacgtatgtttattgcagcactattcacaatagcaaagacttggaaccaacccaaaagtccatcagtgatatactggatagagaaaatgtggcacatatgcaccatggaatactatgcagccataaaaacggatgagtttatgtcctttgcagggacatggatgaagctggaaaccatcattctcagcaaactaacactcgaacagaaaaccaaacactgcatgttctcactcataaatgggaattgaacaacaagaacacatggacacaggcaggggaacatcacacactggggcctgtcagggtgggtggggggatagggggctaggggagggatagcattaggagaaatacctaatgtagatgatgggttgatgggtgcagcaaaccatggcaagtgtataccctatgtaacaaacctgcatgttctacacatgtatcccagaacttaaagcataataaaaaataaaaaattaaaaagacataaatccatcttcaagaattatatcatacatggaagatagagttctaaaacatgtcacagtgtgctcagtgatcaatgttatattagatcaatgcaaactgctataggagcagagaaaaaattagtcaccttccttaggagagaagaagagggcatactatttcacagaagatgtgacatgtgagctgggctaaagcaggctttcagaaaaggagaaggatgccccagagagacaaaaataaatgcaacgtagtcctgtatgttcagagataatgggaaattctggtggctggagcctagtttgcgtatatgcagaaatctaggaatttaattgagaggagccctatgatttacagtaaggagaccttactagtctgtaggtgataagaaacactgaaaaatttcaaagaaaatagtgatatgaccagatggaggactgtatctgctaatcattaaaaggaaaatagtttcttcaaaggaagattgtgccctaagatcgatctccactgcaccagaacagcaaaataatattggttgttttgaattaatatacaacataaaataatccatttgatttttaaagacaaatcaattggattactgtcatccaaaatatagaatcagagattccagttatcttatgatgggcaatgttgccaaagacgtacattctatatttttcatgaaaagaaaaatgcagttatcaagtttataaacatctgaaatgatataatattgtttttaaattcctttttctcagtgaaacattgtttgtatgtataattcttaaacacaatttagctatgacaaccgtgtgtgctgtggaatttcccatgcacacatcactaaagcagcctatctccaggtgtgtccttcatcagctcagagagtttttattcaatcttcagggacagaggagagagaaaaaaagcctaaggacaggccaaggagattcactgactatttatagaataactttgttggagaaaatcagctcttcagagagagggaattaagctttttgtgtatgtttaatggaaacagtagcaatgcaaaatataaagcaacaacccctaatcaaaggaatactttgtaactctaaaagaatgtcagggataaacataaaattaacaattagctggaatgattcgttagtgtcatcttttcttttctgccattgttctgttgggatcttacatcttgaaattattttctgagatatgttacctgcctccctactgccctccaaaatagtaaaatattacacatttaaaaccacttctgtaccttgaatataagttatatatgtctgttgaatttttgtaagtataaaaattgataaatattatttaatagtgactttaaaatttacatcatttaaataacattttgaataatttttaaaatattccactcttttggatcataaatactgcctgatttaagcatttgaagtgtgagagatactttgttcctttttgtttggacgcaatttgatggagctgtagttttttgcaacacttttattgtataatcccgccagcagatccccatcccccatctgttcactatgatgttttcttcccattttattccagaagatgccaagacagcctcctggtgggttaccctggcaacctcatgtgtcgtgttttagaatgtcccagggctgccattttatttcaatttgcatgcacttcagtcagctaactgtaaattaaaaaggttatagaatcaacctttcttttcttgcagaataaaaaaacagataattaggattactgtgtagtaaatataaaaatctacttgtatttagtactctatctaggaaaaactttggttactcttacctaaagtcatggtatttttcacatggcacttcataaaatgacactgcaatgctgctataatgtaagactcaatgggactgcttgatctcatctttgaaaagcatatcactttacagtcttttgatgacatacaagggttttctcagtggaacttttgacatgtctgacagtgtaaaatggcagtgactcaaagttatttgattatatcaagctacagatttcacgtagtctccaatctaattttgaaagcatttctttttaatattttacacctgaagagtcacattctttagttatattttttaaagttagtgacataatttctttttgtctaagcttaaaacatttaatacatatttttgacaaaaataacttacaatttgtattaatcttcaaagatagacttttgcagttttcttaaaagcaagaattatagaagtcttgatatttgagcaaagttgtatgtaaagttagtagcaaagctaaaatgaaaagtaattccctctgagactccagcatttattaggtatcagagtgagagtgatggatcactgttttctccttaggaagaaaattaccatcatgcttactccagtttgtcaggtattttctgatttgctgtaaagagcttaggcattctataatcgcttacaacattctgaggaagatactctgctatgtattggtgactttcttctgttttacccagatttaatgttaccttgaaattaataaccttgtctttctaaggaagggtctctgaagagctttttctaagtggttttgagtactaccataaactcgctctacttccccctttcattccttaggggcacccgctgaacatactttaacatgtatgggataactcggttgctactttcttttactgtgtttccttctaggcttgattatgctatgtcaaatttcagctaggagtttgagaaaaatgatcatgaattttctattttccaaagtcttctccatcctaagagtagtacatgagtcttctgagacagtacatccactaagaatgtttgcatctgaatatcactcttttttcaaaattctcagcgttgtaagtttcctttaaacacgagtttgtaatgaaaaatttaatatataataagagcctgtagtaaaagattattattctttaactccaaaggggagtaaagctagcttgatatcttacttattggtgtaaaaatcacttgaagtagatcacaaggaaagagaaggactggtgcccagactgattcactttgacagactcattcaaattgttcatggtagctaaagtgtcaaatgcaagtttgcctaataagccttattttgaaaacactattaactttagcttttcatgatactggtggctgcctttaattttttttttaagtttagtagttttaatgcttgcctaacaaaggcagatagtttcttctattaccatagtaagtttaactaaccctggatgacggatgcagattagctctggttctaaagagttacaactgagtgcatttagtacatctagtcaagcatgatttttcctttgaaatatttggataaccttaggcacagatgggtaggttagttaaaattatctttcccttgttttcattctttcttgtttcatcttgttttcactctttttaaatttttgtacaactttattgcagcacaatttacatcctgtaaactttacatcttcaaagtatatgagtgatgagttttgacatttgaatatatcaataaaatcattaccacactcaaggagcatatccattagccacaaaagttttcttgtgcctctttgtaatcgcaccctcccactactttcccagctacaaatttgttttctgtcactatagatcagtttgctatttctagagctttctataaatgtcattatacagtatgcactaatttttgtctggcttcttttgcacagaatgttctgagattcatctacattgtagcatatatcagtagttcttcctctttattgcctagtagtgttccattgtatgaaatattttaacccattcacctgttaatggacatttggtcatttctagactttggctattacaaatacagctgttatgaacaaccatgtatgtttttgtgtgggcatatgtttcatttatcttagatatatacctaagtgtagaatggctaggtcacagagtaggtgaatgtttacctttttaacagactgttgaactgctttacaaagccagtatgccattttatattctcaccggcttgatgtgagtgttccagcttcaccacatcatcaccaacacttggccttgtcaatcttgtaattctcatcattctaatacatgtttgttgttttatagttttcaacagtgagcatgtaccatattttgctcatacattcctaggagaaagggtacataatattcatatgccttcaactttctggagctgtacaccgaccagttgctggtcagactgtacgctgaccagttgcttcccagtacaaccacaaaaatttacacttctaccagctgtacatgaggatttctatttatttacatatttgacaatgcatggtattgtaccacacccaaatttgtcctgttcagtagggacataagtataacttaaatttgcatttcttgcattattagtaaatttaagtaattcatgtatatgtaaactacatggctttctctgtttttcatttgtcttttatgtcctaaatttttttgccaatttttgaattgtttttccagtttatttttagaagctccttctacattctagaccaatgttgtacaatacattgaactttctgcagtgagggaaatgttctgtatttgtgccgtctaatataataccaatagctgcacatgactattgagaatttgaaaaatggctagtgatcacttgagctcaggagttcgagaccagcctggccagcatggtgaaactccgtctctactaaaaatacaaaaaaattagccgggcgtggtggtacacgcctgtaatcccaggtactcaggaggctgaggtgggagaatcgctggaacccaggagatggaggttgcagtgaggcgagattgcaccactgcactccagcctgggtgacagagtgagactctgtctcaaaaaaaaaaaaaaaagaaaaatggctaatggcattgaggaagtgaacttttattttacttaattttaactaatttgtatttaaatatttgcatgtggctagtggatactatactgaaaagtgtaattctagatatgagttccttatcagtatcacatactgcaattgccttctttgtggctatttgaccgctatttttttctatggtttcttcattcaacagaaagattacatataaagtgtatatctcaataattcttcccattgatgggtcaagaagaaaaatctttgcttttgatatattcaattgcatcaatttttagttttgatttttagtgtcaggcttttctttaataagtattttcccatgttgaagtcacaaagatagtctcctttttttgttcttttggtgtcagttaatcatctagtcttgttttctcctatgtagtcacacagttttccctccataatctgttaatctctttgtaactaactgctctgtgaagccttacttaccatctttccaaattacatttctatctttctgagctctatattctttcattgggttgttctccgttcttgtgcttatctgatagtgctcctactatcaatcatagttatgacaagtatttaatatccaactagacaatagcctgatgttttggtcatatttttttttcaaaattgccttagctttttgtagatcgtgttctttaacatgagcatttaaaaaaacatgatctttattattgtgtaacttacatagagtatacagctcaatgaatatttatatatgtatataacatgtaattaccacctaaataaaactgtagcatatttctaccactctcaaaatctctccattccctttataatcaatgctccttcacccctagaggtaatcagcattctgaatgctgtaattataggttagttatatacttctctagtctgactccttccaatcaacttaatgtttctcatgtcattcacgttattgtatcagtaagttattttgcaatttatgttgctatatagtattccattttatgaatataccatctttatccaatttcctgatgaacatttggatagtttctaacttgaacttatttaatggtgtgctggtaaacaatttctgggaagacaaaaagtagcatttgccaactcccctggcataaatacttctaccgtggccaagtccaagctgcatggcattaaaacaagctttcaacttttttgtgagcatctacacactaactcaaatgcacacctggagctattatatataaaactgctctgaaaattcttatataagtgggacgtttttgcacatttaaactcatttcacttgggtatgtgtgctaattgtgggatttctaggtaataggatagacatatgttgaattagtagaaactggcaaatttcttaatttgctgatcatgtttacaacaagcaaaattatactttatcaaattcttttctccatttattgacataatcttgtgatttttcttcttgacccatcaatgggaagaattatagagatatacacttcacatgcagtgaaaatattattactatttgatcaaattatactcttttttgaacacacttttggatttgtttagtgttttgtttaggctttttacatagataccatacatttttgctgaaatgaaagcaaaaatattattttaatttcaaaactaagattaaaatttaaagtatataaattagaacatatagaagctctcataaagtttctattattgcttatttttagctgggctttattctataaggccatagtcctaaaactattgtttttaatcctggaagtacactaaaatcacctggggagcttttataaaaattccaggtcctcacccttcaaatcagaattgtaattctggtgacaggaaatagccgtgagaaacatatggggtatcacccttacctcagatagaatctagtgtgctagagatgccttggtgattatgaaatacacatgtacatcacacacacaaaaactatgattaaggagagggttaaatggcctctagttctgcatctagctctgaagttccacgattcttagaaaaggttaatttgcttatttagctttcttcattagttctgcagctcaccaaccagccatccagtgatttcaaagtgcaacttttttgcctgaagtgaaattcacaaagttacaagtgagagactctcacatgtctgcagtctcagtacgtccctttgattttcctaataggagaagccaagatttttgcctttcttctctcccccttcttgctgcaaataggttttccttgtgtttattcgttcatctgtcttctttcccaaccagctgcttctgtaaaaggtatttcataaagctattttcaaatcttacagattcctaatcaacaaagtgaagttttctatattcttaagattatttggggtacattggatgaggtagcttttaagtccatcaacagaagagcctctctatgtatcttttcttttgatcctcgaagaccaagttcttatgagacaactgagatttcaattacagaatgaattgcctgaagtctaaagtttgaattgaggtttatcaactttgagaaattcaagcctcagcatgaaatagacacactccttattaagtgtgttgagtttaaatgtattttgaaacattcagaaaagaattgtctggtgtggtccacgtcagtagagaaaggcatgcaaattgtgagagtcaatatggaagagtagaaaggatacaggaccaagatcaggtgtgaatcaatttggaagagtgaaaagaatataggaacaagaacagtaaatctttgttctgttgttttctgactgctgttgaaaaagggttcacattttcagagcttaagttcctcctccttaagatgggagatgaattcttcccctcatttcagattcctgtgagtaacaaatgaggaaatagatatgaatacttttttaatttgaaaagtgcaatccacgtgaagaatgtatgaatggtaaagtaaagccactgaaaaggaagtgaactttttgcaggatattcacagaaatgagttgaaatcagagctccaagctcagtccagttaatggcaacaatcctctattgtcactcaataatggtggtaacctccactgagtcccttttattttagctacttaataactttgctccacatgaacactttccatcgctatagagaatctctaagaaatcatgtgaatacatttaacacaattatcttagtgcagtttttcctccatgatcagaaaactaaggactagcattagatctttatcagaaaataaattatcatgccttttaattcagtaagtaactttttttccattagattgattttgttgatgaagtacggtctaaaacattgtccaatgtattatgttgtattttgttttccattttttttttcagatataatctgtaagtttttcatgcattttttcttttgggtgatctacggttctctttattaatatatctgtcaatttcctcatatacagagcaattaatctcactttttccctgaagtgtattttttaatatatcagttaggcaaaggaaatagaacataaaatatcagtaaagaaattactatgcacttcatttgctttcagtttgaataatgaaatgaatataggtagataaagtatacatggtagcccccaggaaaaacctaaatgttgtctcctttccacttaaaacatactaggcataatttatagtggagagaagtagatttttccaagtagcttgtagaatttagtactgggatggcttagatcaatagttttgaaagagggagggggaatgattttgcctcaagggaactttcggcaccatctggagtatttttggttgtaacagctgaaggggtgccataggcatcttgtcacagaggccaaggtaggctaaggctaaacatgctacattgcacaagacagccccacaacaaagaattattccagttgaaatatcaagagtcggagattaagaacctgcctttgattcaatgggtgataaattccataacttgaaaggagcctctacattaggccttagggatggaaaaggaaaaatttcataaaagcgagttgcaatagtgtaaatgaaagccacaatttcagctggtagccttgagtgctgtggtgttcacattagctccacctttgacactttttaaatttagagaaatgatcctagtagacttacagtaaattatatctaaagccgttctatcaatggatttgggggattgcgttggtgagagctttgacctttgtagatcactgaaatggccaaaaagaaaaaaaaaaatacagaggaaaatagaataagaacaaaatccagaaaggtgagcattgagtaggcaatggtaatacaactgtatatcttgttctccgtagctctttgggaggggaaggaagcaggtatgacagggcttgggaaggatgtggagcctactgactcagaatcaaatcccagccggagggtatctgccagtctcaacccacagcctcagatcttatagctgaccctggtcctagaacctgctagggctctgggacacagggtatggattccgagggtggctactgccctctgtgggaccctcgcaatgggacatggggctctgtgctctggcgagcgtgcagtacagaacaggagtgcggacatgcaggggaccgctgtgcgcagagctgaggctggggcactgagggttctccctcttgggcagggaaggacagggcgcacgcgccaccagaggcgcacaggaccggcgacggctgcactggggctggaactggcggcagggcattgtcagggcgggacccggcgatcgcagggtgggcggcttgcagggatcagaagcaggaggcaggaggtccgggcacccggctctgggcatcaggccgctctttatcctgaatccccgcctccctctgccctgacgccctgcgcgcactccatctcaggccgcgaagtgggccatgtgagcagtctccctcctcctttccccgcgggcgacacgaggagcccagggcgcagcgggctcgaatcacatagtgcccgccccggatttcgtgcgcagagagaaccccaggccccacaggccctcccacgctctgcccagatccctgggcaagagtccaccgtcagcatcgtcgcttgtaagtcttgtctgcttagttagacagaacttccaagaactggaagttctaaaatcctttcccgcactcttggtgggggttgcagtaagttgtggagagagcagggagatttgacccggatgaatacagtaaatctttaaaataagcatattgacgatatagtttcatctttccaaactgctattaaatacgacctgaagtgaaaaatgacgtccatgttgagtgcaaaatttagagggctgtcattagacaagcagacctagtgaatgggatcattctattcagctggaactaggcttcttaacaagagtagcagaagtcctttcaaagacttaaaaataagttcccatcatctatttcttgcatacatctagtgataacattgattttatatgaaaagaaatttaaggttagtgccaattttgttaaaactctgaccctgtgtatattttacaaactttttttttttggaacagttttgcaaatgtgaccatatagaaggagataatttgggagtagggggatgaagaaacttttctagaatataaaacaaatttaataagaaacctgttacctaagctactttcatacagtttcagcatgctggagtaggaatatgaagtttttgttgttgttgttgggtctctgcttagtaattgtgtgatcctaaacaaatcacttaaccgtctgaggctgttttcctcaaccttaattttgtaagagacagtcagtgctttgattagtgagaatatgatacactgttatttttcaaactgttcattggtaatttgcttgtccacccgacagccttaggtagataagaggagatgggttgggtaaggaaagacgtgtctttcccaggtaattctgatcatgaccttttcctcattcccttccctttaggaattttttgaattctctagtggacagaggctggttaatatgtaactttataaactaccatatttgatttttatgccaaaggttttcctttagtcattttttttttctgaagcagaaaagtagtgacatatagatttaaaataggatggcgtggtgaatgctttacctttgagctgcatttagtatgtcgtttagttgaaatattttatttgtaaaaatgagtttggcacaccacacatgttaaattttcaggagcgggctcagaatatttaagaatgagtgatttcacagtctattgggatatgaggaaatatctttataagctaattaagattttaattcttaatttgattcatttgtctcacattgcctgggtgagttcaaccatttaaattgggcaaactcagctaagccccttctcagcctgcaggcatgcccagtctttgtcaggaactgcagtataccaaggaccaaatctggttttactggaatttaccttgacagtagtatccgtaatgactctttaccattttttgagtacttaaaatatttattatttggtaggtcatggttagaaattatctcacattttatttatatagattgctataatacatacatgtaaatatatgtgaaagtgactaaaatagtaaatttgctgtttaattatatcataaacatacatatatccataggatttcaaagaaaaaagcattactgattttttgttttgtattaataatttgatatagaatttaagtcagttctcagccttcagtggggtcctacttgggattgcttaggtcgggtggatagtctgtgcaggcttgattctataacgtgttcctcagctattttgaaggttacagttggaaaattcttccttttttctgaatctctaagatatcataacaggatgttaaaaatgggagattcttgtcagggatgcaagaaaacaatttatgctcaacaaattccacactcagatctacgccacccatacaggacttagaaaggagatggtgaaacctagctttcaactcttggcttatccgttatcaggaggatatattagtggtagctacaggttaatggggacgttgagaagatctgcagagatggtttgtttggacaaattatgaaggtctccactctttcctcatagaagagggaaaggggctgctttatgaaggaagtgtttctaactttctcaaatccagtcggagaagtttcaaagtatcaatttatagggcctaataacattccttggagttttggagatgaatgcttacgtgtacctgaaaacatgcccttggctgatcacagctagaaacctgcattgtgagtgagctataatgacatatatggtgggggaaggatgtataagttttgacagttgatgcttggaaaggagttggcctagcactgctccaggcttctcagcataagatcgatccaggatgggaaaagataaagttttatttttgtatgaagtttgaagtttggattattacattaaatgtatactttaagaaatgagaccattttttgactaaaaagaaccagaaagctacttcctgaggttttctccaggaacaggaaaagaacctgcccacagaagagggttgaaagactaggaagagattccttatgcacacaaagcagtctaacttctttcatgacatggttatgccataatagttcttttgcctctggctcagctataaaacctttgtcaatgtccttaatctttccaaagttttaatttctatatcagtaaatgagcacaatattagaacctatttcatatattatttgtgataattagactataattagcacagtgtctgacataatgtaagcaaatatagctgttattaatatgattgattcttacacaaatgtcatagctcctagttcagtattgggctcacttagatactagtggaagtctgtttcattgaattattaggatgagttggttgatgcaataaaaactaacaaattttttttatttgggctagaagaaagtggtgaccaaaaacattaacttgtctgactccttgattctgtgtattgctttcaaatgtgaggaaaaaaaagctacagtttccctgactagtcttttccccaactccttcagtactaaacacaataaaaatagcatcttagggatacaactaaaaatgtagttattaaaatctggttacaaattggaactctattggccatttttataaaacagttttagaaaagaaaaaacttctgatgatgaacttttgatgaacttcttatgaagttcaaaatagagtccaattgttgaaaaaaaggcaaagctagtacttctagatcagatgttatcaaagtccaagtcctaatgccattgaattgtttttgaattactcaaacatcaaaggctcgtgtggctgtggataaatgtaaacatttgaaatctcagaagcactactttggatttaaacactaagaaggttcacgcacacgttgtgaccatctaagaagtaataccactgttcctttctttgactttcctaatgaggaaaacaaactgatgtgttacaaaatgaaagacaaatactaaattccagaggagggatgtgtgtttaggaaggcactaaaaatgtcaaaatgggtttttatagtcccataaatacaaaggcttggctctggactttttgttaacttttagtaaaattacacaagcaagtctttgcataccaggagaatttcttcagttcataaaacacccagagaagaaagcatcaagctcaccaaaaactagctcaccatgacttgctcaacaacacaaattaagctttaatatatataaaaaagtgggatatccatggtttatttttctgctatgaggggaaataaacttagcactttcatcttgtctgcagtctcttgttttctaaacatggtatcaaggtcatttatttctttgtacatatgtaatcgctaggatctgacaaaataactttgtgcaactcccgttcatcttatttccacatcttgtaagttcttaaactgcagagataaaacatttccaaatgtgggagtcacagtatcagtacaaattcatccaaacttagaagtcttttcatatttttaagtttccttgttgggatatatatcttttgatagtgtaagctgtatccttgtaagaaaattaactaaattttcaaggcagtaaataatattgttttagtgaaaatgatggtataaatagtggtatctttttaaaaacttatttcttttctgcacccttcttgtcttctgaaaaagtattctaagcaagcttgaaatataattctgagttggaagtattctcataagttacttagtcctacaccttcatttaatagctgagttttagagaggtcaacattccagatcaactagtaaggccaaggctagaagctaaaaccttaagtgtatgtctttttcattctttataataaaaagcagctcaggatagttaatctgtgaagatgtcttgtttcaccttgttttgctttttattatttaaaaaaattggtttcagccaaatttacataagtggttttgtagaatagcttaataatttgatatattatttttaagagattagaaaataatattatttaaaactcagttgtatgaattatcttagttcatttcaagatatgaaactctagtttaaaattatgagagagcatttagaaattatctgaaaaaaagccataggatttgttaataggctatctcttctttggtaaaatctggcaatttttccccacattttttagactctaactttagtgatagaaaaaaacaaatgtttaaggaatttgaaacagcatgctttttttcaaatatttttagtagtgcttattttgtgacttttaaaattttagggtttggtatattaaatattctattatgtgctggtgtgtatactttgcttgaaagtttaaattatggtaaattccagagttctgagttatataccttgtcaaacttaacctcttgatataccttttttggaaggaaaagagtttaataggagtttactgggttacatactaaacaatagtctggtttattcatttttaattcatataatacagtaaatgcacagaaattcatttgccaataaaaatgtttaagaatttttatagatgcaaaaggaatcaattgtttattaaatgatggcaaaattggcaatccatttgaaaggaatcaaacagattgtggatcaattaatgtatggttaacaactaaaataagctattattttaactataattaggttatattgaaactgtaataattttaattagagattaaacaaaaacttgcaaattgacaaaatgaactttatgattttaagacaactgtgtcaacatttatgtttctgaaatcaatacgtttttatgtaaaacagtgtatgaaataaccattgtttttccataaaagcttttgaacatttctatatgaataagatatttcacaagtattcatctgcccttcaaactcctttaattaaatctccctttcttcagtcaccataacttaaagcaaaacttttttttttttttttctgtattgggctaaaaaaatggtgccttctaatttaaccaaacatgtgagagacttgacttgaaactagataagtaacaatgaaatcggctatttgaagaaaatctaaaacacgtttgatacttccacacagattttcttctatttaatatatagtgatgttaaaatctttgggagtagttgaagacagacttggaccattaagtaaaaggcagatgatggttcatccatgtcagttcttgaaattggttgtaaaatgcaccatgaaataaatgtctctcatttgctattatgtccttagatatctctggtattacacgttagcctacagactgaaactgtgggacttaagcacttaattaggtgacccataatcagatacatttttaagaataggagtctgggatgtccgcaaatataaacatttaaaacattgtggtgtatatgacataatgtttctaaagcatcattgaaacttaattatatcctggtaacagttcaagaatacagagttacatttggttctttaaaaaaaaaaaacattgtcattaatgtttaatcattattgttggtttatacaaaacaaggataatattcttcctagcataagccaattaagttatcaacatgattgtgcttttcatcacacactagacattttatattatcatatattggatcttgcactcatttttaaaacaaaaagcaaacaaacagcagtgaaaaaaccatcttattaatggtgaagaatgtagactttggagccagactgactgcaggcaaaccttggctccataatttcctagccacacgattttggacacactagttatactccctgaggctcagcttttaaataaagtaacataaggtttgtaccttttttcaaagggttgctgagataattgaattatttaaaacatataaagcacttagaattttggctagtacgcagaaatcatcaacaaatgttaactaccagctagttttcctccctttctgtcctgcttttcaaattattatcttgtgttgcattctcttctttctttaaatttttcctctaggtcctatagatatgattctgacttatctaagactaagttgtgtgtgtatgtgtttgtgtgtgtatgtgtgcatgacagagagagagaaatagtaatattttgatacaagacatagcggaagcacttaaaggatttctctttacactaaagagccatcttataattagaggcaatttcatagcctgttctacctacatacttaaacacattgtttacaagtcttaatcagtgaccaaaatagatcagctatcactatatacattaaaaccacttgttctcacactttttgataattcctttaatgatgataaatctctgaaccagcaaaggatagtcaaatatttttgtaactaatgtggaagcttttagtgtagtagttgagattattgagagaattaggtagtagcaaaattattgctacttaatagctgtgtaacctggcataaattactcaactagactccctctttaaaatggcttgaagattatacatttctgatgatttacatgagtccaattcacataatgtttctcatagttcatataatgcttcaaacaggagctggcaaggagtaaacagaaatatgattgcagtagttgttatttacttttcagttgtactacagaagaatcctattttttgattagctcaaaagtcataagaaactgtcttagtcttcagttttgctttggttgtagaaactcagcctcagaagctatcacttccagatatacctaaccacatcttgtcctgccaagatccaaacaaaaaggtcagtcatttcttatcagaggataaatcaattggtgagtttcccagtggcaattttcacaaatgttgagactttccaggatctcttaatgtggggaaaagtgaacatggtgatttcaaagacatttacccttcaagtaaatttcagcaaaccaattcccaaatcaaactgtgacccagagccttttatgtctcttaataagagtgacaaaataattttttatttttcaaatatgcaagtccacattttattacagttttttagaacattagagaaaagttccacataaaatgaaagggaatgtgtttgtgggctatgaatcaattctgaataagcaattattagggctttcatcctcattactggggacatctgcagggttagaagctcatgctaagtcactcaacatttatgggatatccagtgtgtgagagctgagttctgaataatgcagcagcatctatggaatatatgaaattttcacaaacaaatatttttaggcataaattattttaagttgcctagggatatttttgaatgaggtagaatattttgtaaaatcaagcatttattagaatggacattactgtttgaaaaggaaaagtatgtatgggccctacctatagctgtgccaaatattaataatgatcatgaaaccgctttaaatttaaactaaaaatcattaaaatgctatgtttaagattttagaaaatattatagtttccttgggaatacagtattctttcaaaatattttgtgagttatcatcttgctaaactagcaatatttacagatatttttatccttaagcaatatttaagcaataccctttgaagcaatatttaagataactgaagatatctggggagttgtaaagacagttgtgttattatatgtgcattttaaaccactttctgacaagaaagtaaaaaagctcaggcattaaagggattatcttttagtctctaaaagtgtaagctgacaagaatggataaaaccaataagaaaaattcatactctcatcacagatatgcccagagttgccttttaatttttcttattttctgcttttgcagtatactgtggaaaaacagggagcaggaaacagaaaggagtaatctctcttctgggagagcagtgtcttcaagctggaaactgtatggaatagagaatggggagttaaaggtttctatcattcaggataggggagcaaaatacaaaatcaaaattctgagattaaatacagatgagaatgctgtacaaggcattaatctcttaaagaaaaaagaacctctatagaattttatgagttgaggttcaataagattctgtgctggaaaatatgacagacacagaaataagttatttcaagggcagatgaacattgttaattgtgtttctttgagcagttccttacacgttgctaactggaaatacacttgttatgtgacatcatcattttaaactggggatttagcaaataaataatataataaaaactctcaacttatttatttcttcctctctatctttgtataccttgctgcttaataaaattccatccgttaggcctttatcccattgctctcagaaactgccaatgttcatttttgccttttgacttcgtatgtttttaattctgtttggaagattatctactcccttctctggctattttaaacatctctaaagggtcagaagaaattttgcctccttgacaatgtctttaaagtttctttctttctttctttttttctttttctttttgagacagggtcttgctctgtcacccaggccggagtgcagtgctgtaatcatggctcattacctctcacgctcaagtaatcctcccacttcagtctcctgaggctgagaaaacaggcacaagccaccatgcctgggtaattttttctgttttgtgtagagtcagagtctggctatgttactaggctagttttaatttttttctgccatagttcttttttttttaagcggggtctacaagtgcacaccaccatgcctgactaatttttaaattattccatagagatgaggtttcattttgttgcccaggctggtctcgaactcctgggctcatgtaatcctccttcctgggcctcttgaagtgttaggattataggtgtgagttactgttcccagcatctgccatagttcttaaccccttttactattgtaattgtgggtaattactacaaaataaaatgatgtaattataatgattaattataatttcttaaaattgtaaactaagaaaatatagctccaaattatcacaaaaactttcaggcatgggtcccataatctacttctcctgtgttctcttcagtgccagtaatagtgacagtcacagccttggaaatagagatgagggtcaatcagtgggaaaattttatgataaaatactatatttacagaaatactaattagctgttttatattaattaaatataatgatactctactgccatactataggatattgcatttgcagacccttcatagatgtgtctcaagttttgatcaattcataacattatttttttaatgttttagaaaagctgctgggcattggttaggatgctgaatttcagtgaccatatgtgggctgaggctagccaaactcggacttgaagctgtttgagagtgactaacatgggagccagagacttaatggagggggcagaaccagtgcaagatgcttggtgtttcctcttctgtgtcatacttttgagaaatttgtgaatgaggacaaatggtcacatgtattgagtattgggataatggtggtagcagtcttctaattgaaatctaattgtatcaggaaaagccgactacaacagaataactttaaaattaggataaaaatgtcataggtagtgagaggaaaaaacagtggtagcaagccatcttaaaaagtgatataactaaaaacaaagaaacaaaaatagacgcagaaaaggctttcaataaaattcaacatcccttcatgctaaaagccctcaacaaactaggcatcaaaggtacacacctcaaaataataagaaccatccacaacaaacccacagtcaaaatcctactgaacaggcaaaagctgggagcattccctttgagaaacgggaacaagacaaggatgaccactttcaccactcctactcaacatggtactgaaagtcctagccagagcaataaggcaagagaaagtaataaagggcatccaaataggaagagaggaagtcaaaccttatctcttcacatatattatgatactatacctagaaaaccccatagtctctgcccacaggctcctagatctgataaacaacttcagcaaagtttcaggatacaaaaccaatgtataaaaatcaatagcatttctatataccaataacatccaagctgagagccaagccaataacacaatttcattcacagtagccacaaaaagaataaaataggaatacacccaggaatacagctcactagggaggtgaaagatctctacaatgagaattacaaaacatagttgaaagaaatcagagttgacatagacaaatggaaaaatattccatgatcatagataggaagagtaaatattgttagaatgaccatactgcccaaagcaatccacggagtgaaggctattcttatcagactaccaatgacattttttcacagtattagaaaaaaaattctaaaatccatttgtaatgacaacaacaaaaaatcccaaagagccaaagtgatcctatgcaaaaagaacaaagcaggagtcatcacactacccaacttcaaactatactataaggcaacagtaactaaaataacatggcactgatacaaaaacatacaaatggaacagattagaaaacccagaaataaagccacacatctgcaaccatctgatattcaacaaacccaacaaaaacaagaaatggggaaaggactccctattcagtaaatggtgttgggataattgactagtcatatgcagaaaattgaaactggacccctacttttcactgtacacaaaattcaactcaagatggattaaagatttaacttcaaaacctatgattatgaataccctagaagaaaatctaggaaataccattctggacctcgacccaggcaaagacttcatgatgaagactccaaaagcgattgtaacaaaaacgaaaattaacagacctaattaaactaaagagcttctacacagaaaaagaaactaacaacagagtaaacaggcaacctatagaatgggagacaatatttgccaaccatgcattcaacaaaatttaatatctaaaatatacaaggaattcaaacaaatcaacaagcaaaaaccaatcccattaaaaatgggcagatggtatgaacagacaattctgaaaagaaatcatacatacaaccaacatgcatgtgaaaaatgttcactatcactcatcattccaaagtcccttccacattttcaggtacctttatagcgataccccactcctgatatgaattttctatattagcccattcttgccctgctataaagaactacttgagactgggtaatttatgaagaaaggagatttagttgactcacagttccacaggctgtacaagaagcatggttggtgaggcctcaggaaacttccaatcacagcagaaagatgaaggggaaataaacaccttcttcacatggcagagcgggaggaacagagcaaagggggaaatgctacacacttttaaacaagcagatcttgtgagaactcactatcatgagaacagcaagggggaaatcctctcccataatccaatcacctcccaccaggtccatcccccaacatttgggattacaattcaacatgagatttgagtgggaacacagagtcaaaccgtatcactgagtagatacccaaagtaatataatttgttctatcataaagacacatgcacaggtatgttaattgcagcactattctcaagagcaaagacaaggcatcaaccgaggtgcccatcaacagtggactggataaagtaaatgtagtacatatacagcatggaatactacttaagtataaacaaaaatgtgatcatggcctttgcagcaacatggatgaaactggaggccataatgctatacaaattaatgcaggaacagaaaacaaaataccacatattttacttataagtgggagctaaacattgagtacacatggacgcaaagaaaagaacaatagacattggggcccacttaagggtggagtgtgggaggaaggtgaggattgaaaaactacatattgggtattatgctgattacccgggtgacaaaattatctgtacaccgaaccctcacaacatgcaatttatccatttaacaaagctgcatgtgtacctctttaaactaaagtaaaagttgtaaggaaagaaaaataaaaattatggcgtatttattttttattatttacagtttagggtattttctataatttccccaaacaaaatgataggacagtatgatctgctcctttcactttatgtttgagtcctgcagcatagtctctaagataattctttttaaaaatatctgacatgaggcataacccatttttaccagagatctttattaatgctttgatatttaaattgatcttttctgaggcttagctaggtatattattcttttctttagtttttaatttatttgactgtgatgcatttccatttgtcaatgagtttctaattctatcttccaaaatcatttttagtagttcactacattttctatttcaatctgtacttaatttgaatttcattcatgtgatatcttcagtgctccagttggcaatcatgaggaatttaacagtaaagaaactgagcagtgaagatgggtaactaatattaatggggaaaacctaggaaccagttttataagtggtcaattcacttctgaatatttttgggtagtgacgagttttgttttttctatcctatcttataaatttaggggtttagaaaataaatacccaaatactagggaatttctatacatttttttagctagaggttaaggaccgattgtgacttgactaagagcccaaactatcactcgtggaagcttcttcaccatgagtcttggaactctctctgcagtggcacagtggactaccacgtctccagaaacatccgtctgtgggtgcatatgaccatgttctaaatatttctgctcattctcatcatcctttctaaaataccattaatttcctctttttctctctctccccaccaccttctttcgtgattgatactatcttcttcaacaaattttagctgtgtgcttttcaagagattgaaaaaaatagactgtatttctggagcaatttaggtttgcagattaattgcacagaatatacagacagaatcccatatatccccctttcccttgcacagcttcccctgttataaacatcttgcattagtgtggtacattttttataattgataaatgaatattgacacatttttattaactaaatcccatagtttacgttagctttcactctgttttacattgtataggtttggacaaatgtatgatggcatatattgacaattacagtataatacagaatggtttcactgcctgaaaaatcccacgtgccctacctattcagttctccctcccttccttctcctgagatcctgatagcctctgttatgtgtactgtctctatggttgtgccttttccacaatcttatagagttgaaattatatactatgtggccttttcatatcggcttctttcacttagaaatatgcttcgaaaatttctccatgtctttttatgtcttggtagttcatttctttttattgctaaataatatttcattgtatgaaagtaccacagtttgttcattcatttattaaataacatcttcgttgcttccaagttttggcaataacaaatcttaatacgtggacgtaagttttaactcctttgggaaaataccaagaagcattattgaccatatgatcccacacagtatgtttggttttataagacactgccaaactttcttccagagtggctgtaacattttgcattaccatcagcaatgagtgagagttcctgttgtactatatactcaccagcatttggtgttgtaactgttttgtattttggtcattctaataggtgtgtagtggcatctcattgttttatttacacctccttaatgacatatgatgttgagcatctttctatgtgcttattttccatctgtatatcttctttaagtatctgttcagatttcctgcctactgtttaaatgggtttttcttcttattgttgaattttaagagttctttggtattttggatacctgttctttttttacagatatgtgtttggcaaatattttttcccaatctgtggcttgtcttttcattttcttaactttccggagatttttattgctaatccttcctttttatgataaatgattccatcattttcatacctaattcaaaagacattcattacagtctcagaatcttgacatcttcagtctaaattagcacatactacttagaatctgacctaaataatttgctattttattataaaataaagtttaatataatgtatatatcatctgtatatatatgtataatgtatatatcatccaaatcagtcttttatttcctgcttactcatattattagacttttttctttagaataatagttttgaattgttttctgctaattagccatggtttctattttgaactttctaatgtggtgtttattgaaataaaatctatttttagtctatcattttcttactacagtttttatgaagtaatctttaatgcatattgctaagtgaaggaagcctgtctgaaaaggctgtataatgtatgtagccgtacatatccaacaatatgacattatgcaaaatgcaaaacttatagtaaaagatcggtggttgctaggaagttggaaggggcaggatgaatggaaaagcacaggtgatattttaggacagtgaaactattctgtatgatactttcatggtggatacaggacattatggatttgtacaaacccatagaactgtgaaacaaaatgagtggactgaaggtaataacattgtattggtattggctcattagttgtaatacatgcaccagtaatgcaagatgtaccacactaatacataggagaaactgtgtgatagagaagtagaaggagtgaagctgagggagtaatgggaactctgaactttccgcttaatttttccatcaacctagaactgttttaaagataaagcttattagctaaaaaaaaaaaaaatatctctttgcacggggatctatttattaccatggagaagaatgaagtcttgggctcagtctatcagtctatcttaatgtttactttgaatgaaggacatactcctctttcatatggatagaaatgagatagaacagttatcaagatcctatgcagagaattgaaaaggctgttgtatgaataaccgatatgagttatatcagaaacctaagttcagggaagaatacacacacatataataccaaaaaagaaattattcaaatgtttattagaatagtagatgcaggtaagtacatatggagtgaagtatagctaaaatccagttatgtcattattcttgataaaatgttttaaaagaaaccaacaaatttgggcacatacagtgatttgtaaagagggacaggtgatctggaattatttgagatagatacggttggtgactgcagtagggttgtaaaggaatctggctagttctgatactgtgtttcacctgaaaaccaggatcacaaagctatatcctagcaatatctactcacaagccaaaatctattgtcttaaaatttctgctcaccttttttagttttatctgttgaaatgtaagttttaaatgtaagaacaagtctgatctaggatatattaataatagtattataacttctttttgttttcccctgttgtgtatacatttaatcaatagcctagttcttctcctgaccttaaactaaagcaaacctcttaatcctttggccaaacaagttttattttaatgattatattttcaaatttcacataacaataaaaactctgtgcctgatttgaagttgagagctctctgctccatgagtttaggcctgctgaataggctgaatgcctacagttggagaagggaaagtgattcatttctcttctccttccctatctccctcctctgctcctgccagcacaggggttagagcacaggagagggagaaaggaatgcttttgctgaaaggatagctggtaccgcccctgggtttgctgcatccggcaggagttaaagctatcctcatatgtatttcttgtagagtgctctccctggttattccagaaacaccagtcgctgaggatctctcacctgcagttccctgctggatcttcattctgactggtaagttattccttctttgctgaggtcttcacacctcctcctgtggttttcatggaaaggaacttatgtaaccccatacttgctccttcgtgtgacctgcacctggttgtggaaaatcctgatgcattctttttccttaaacctctgagtacctgctgatccccatgtggggataatctctcctgtgcttttcattagaaaggtagccaggtgcctggtttctgtgtattttccaacccccaggagattcccatcactccccatagctcttctttgttgacttggggttgaaagatagtgcttccccatcccttcattctttgaaaaactctactttaaacctttattcatcatgaccgaggggtgtaggagtcacctcgtgattcctggcttccataataaatccttgttcagaacctcactttcccattttaatctcttacaacagaagcaacccagaacatactttttcttcaaatattgagatttgtaaagaatccttctgtcatctcatttttatgctaaagtcatttactgaaggagtgacatccccagactcctcaatgtcatctttcctgttttgagcttaatgtgatctaattgaagaggaccttttaaatatgtggcaagtaataagacaaacctactagaccaacaatgataattcaacaaaagacacatatttgtgatgtataaatcaaatgctaataagatatgctcaacatttaagtattttacccatgagaggagtgggtgatggttttttaaaatatatatatatatatgtatatatatgtatgtgtatatatatgtgtatatatatgcatgtatatatatgtatatatgtatatatagtgtatatatgtatatatatgtgtatatatatatgtatatatgtatgaaaaagggttagtgtgaaaggtgaaagctccctcctatgaaatggcagaagaaattatttaataaattatccgatgcatattttgtagatttctatatttactttccttagattgctaagtatgaaagcatgacctacttttcctcaacttatgcctcatagtgggtatttgctctattctctgtactgctattttctccctgagtcactcttctacagaaagcacttccaaaatttactcattaaagacagagagttctgagaatcttaatcaaatattcatagtttgtattcatctggttcacaagtctgtgaattgccaatttttgttgaattatttatataaaaatgaacacattttaactcttatttaattggcagtatctaataatatctcccatttgctactcgccttgtggacattgagagaatggttcagaaaattcaactggcattggggaaggctgacctagataatcctttttttggaaaattattgatttgtgccagattatacattaaaaatctcttcttaaaattatgtcactcttttcctttctcctcagttaaatctatgggatctcccttttttttgtttctcaattgtatcaggttccagccccagctgaggtccaagggtagtgggtggatgaatggcagatagctgaaagaacactcgggggccataggcaggtgaaatgtagttttattcagcagctctctcatcagcagcttaatcacattagctctctcacattgttcacctttatctccgctgtctgctccagctctgcggcgcctgctgaccccatgcctacaacagcatggccggctctcccttgccttcagggtcagcagcttaactctttctgtctctgggcaccagcaggagtcctgccatgactcctctctgtcttgcagatggacacctctggttctctctctttctctgggtaccagtgccatgtcaagccatgcccaggagcccttacagtgtcagcagggcagttataccttctacagacaatagtggctcagagccaagtatgaacttacataaacagattatgtaacaagcagaatatgtgcctgcaccctaaacttgctgagtcatgcaggcctggatgtctgccttggcctaattcttgaccaaagcacatccatgtaccttacactctacccactaggttgagggagacataggttttggacaaacaggtttgatacatagctttaggcatgcagacccactatacagctttggcacataggccccagacacataaacctgacacatatgctctgggacgcaggtttgggcacgcagccttgatacatacacaggggctttgataaactgcccagctataggtgcagattaccataggtgttgtctccttggtgattaccattctcagtgccctgaattcagctcattagctactttgcctacacctggtttcaaaccacatcgtgtcagtactaggctggattgtgacaccagtccaggcagcagtagcaccttggctagacccatctgtataccatgccctattaggaatggggggatgcacttcctaatggtgaaagctcagcgtctaggggtgcctcaggccccatggccttatcttgcattaggatcctaaggcttcttgtaactctgctgctaagggagttgtactcagggtacttcattcttccaggtaggcaccccacttcactaaagtggatatgtgccatcccagtccggggggccatgaatgcacccatcctgctattgggtaagttgtccacacgatgatgactgtaacccatcctgacatgctcttatgagcctgaaaggcagtgtatgcagttactaactgcttctttattaatgaacaccagagctcagctcccttccatatagctgggactaaaagcttactggttcttccaagtactccatgcactgccataggctctaaccaatactatctgtaatttcatgtacatcaagtttaaatgggagcccctggttaactacctgcagggcttgagcctgctgaatagcctgcttggctattggaaaaggctgcctcagtcttatccaaatctaaggcaagaggggcgttgccacttttaaatctgcaagagaatcagaagttaacataacatcatcaacaagactatgacatagagtggggctatgcatattgccctgtagcaacactgtgaaagtccattgtcaccctccaatgaaggcaaactattcctggttctctggacaagaatcccagttccattgttaagcagtccagcaagtctgtgacagatggtacagctgccaagccgtgtaaaacatccccagccagaatgtcctcaggcatgggagagacatacacagttcatgagcggaaaaccaagcagcagataccaagatgcaaagatacaggtttcgctttcactgaccagtcttcataaccatcaataactgcagctctgcccagaaacttatccgggttcagagtccagtagattgccaagtccacatatggtctttggtcatccagtgcccccctaagccaggcatcttggtcagtctcttatcaaacagaaaaggctttacacttccacctaactgcagcaggcagtctgtgaactggaatgcttgggcaggactgggttgcgcagcaatgtccttctcccatgtgacttacactaagtctgcacatgactgccgagattacttgcttaactcctgcaactcagtgggggtataagcactataagagctgtgttccaccactgtgggggggccctgggctctcccctggggtcccattggctgctcatgttctgccttctgatggatcacagggtgagcccgcagcagaggagcctcctccctgcctggcatcctgcaggaactgggcatgcacctcccgcagcacagttacaaatgcccgtctgactctgctggcaaaggcatgttcctcattggtgctgtgcacttccaggtacttcagtgccctcttcatactcacaggagacccatccactgcctcccatgtttccatcagatcccatcctcctcgcagcatggctgccactgggtaccacagtccatgctgcggccacagagccaacccaggagccctcaggggctgaagacccactcaccttatcctgctgacaatgccaattgtcaggttccagccccagctgaggtccaaggggagtgggtggatagctgaaagaacactccgggggcgccataggcaggtgaaatgtagttttatttagcaggtctctcagtagcagcttactcacattagctctctaacactgtccacctttatctcagctgtctgctctggctctgcagctcctgcccttccggcagctgcatagcaggctctcccttgccttcagggtcagcagcttaactctttctctctctgggcaccagcacgagccatgcaatagctgtcctctgtccgtctgcaagacagacagctctgattctctctctctctttctctgggtgccagcgccatgtcaagccatgcccaagatcctgtacagtgtcagcagggcagttataccttctacagacaatagtggctgagagccaagtatgagcttaaacaaacaggttacataacaaatggagtatgtgcctgcaccctaaactcgctaagtaatgcaggcctggatgtctgccttggcctaattcttgaccaaagcacatccatgtaccttacaaattgtttgtcttctaacaactgataacctagaaaaacttaggcaagcaccaaacaacagaatagtaactcagtaaaggaggtgtggcatgcccacaaacacagaaccagaaggccaggctgagtggatgtgaattcctttttgtcatttgttagctactttatattgggtagatttcttaaattctgtgacatagttttttaatctataaaaataaataatagggctggttgcggtggctcacgcctgtaatcctagcactttgggaagctgaggtgggcagatcacaaggccgggagttcgagaccagcctggctaacctggtgaaaccccgtctctactaaaaatacaaaaaaatagcctggtgtggtggtgggcacccggtactcaagaggctgaggcaggagaatcgcttgaacctgggaggcagaggtttcagtgagtcaagatcgcgccattgcacaccaacccaggtgacagagcaagactccatcttgaaaaataaataaattaaataaataaataataatagtatcatatacctcacagagtagaaaagaggattcaatgagttaatatatccataaagtgcactcaatgaatgtatgtattttagtatttctaaaataataatagctcacaaaacaaatgccaaatcctaatctgtgtctaacagttacagaaattgtaccagtctcaatcattttcacataaagcagaaatgaaggttaatacaatttccttcccatggttatcgtttgtgtgacccttagcacactggcttgaaaattctaaaaaaacacaaacacagtacactggaatctaaacggacaaactattttcagaagtattggctatagagtgaaccatagcaaaggggaccaggaataccttttgctgatcaggatatttaatcctgcacattggaagaaaataagagctgtcagcaagcacacacaccccattctagaaagaaaccatccccgacagacttaatgggtcatgtgttctggtcaggtcgtagggttcatggttccctcactcatccctcacagaaggggcctaaatgggaacccttaatgctaagggggttctgtgcaattcctgaacctatggttggaggtgctcctgatgttttgctggtttaaattaccttctttgagtttggaacaaattattctgaagagttacattccagtaccctgtctacttttctatttctgtgtttcctgtttgttcctcttaccactctggagatacaggccacagtgagattgtgttcacagtgagtatcatggtaaagaaaaaggtggaatatggttccctagtcctctccccaccctgcccctgtagacctcctgccaacacccacactgtgcagaaagctctgaggataaaagttcatggtaaaatctagagattgttttaaaaatgtctctgaaatgactaagttgagagttatgttttcctatattaatggaactttgaaatggcaaatgatttatattgaaatgtatctttttctaccatattgtgtgttttgtaagttataacctctatgcagtcaataatgttatacatttcaaaaataactgaccctcaaattccaatattgataatagctctgcatcaatcaatactagtctctcagacaaattagtgtttacattgaccagaaaaagtcattatatgcatattagctaggtaccacaacataaattgaattaatttaaggagtgaaaaatatacagctttttgtattatttcatatttgatacttccagccttaattctttaccacatttttaatgttaacaaattatcccaatgagcagctatctgctcattaagtgaaataaaatatataaaattttagaacaatgtctggctcataaaggtactcattaaatattataatctgacctccttcaatttttatctttcaagactaagaaattaagaatttcatcatctccattatatatctacatatagatagaaatgctagaaaatgtggcattcacattaaagaccaaatgctgcctcattgatgtggctgatttattctcagaatggtgagtgtggatggagattacaaattggggagtactgcaatgttttacaagaacacttgataaaaatgtcactctttctctgccccactccaaagcactgtccatataacaggatttttatgttcaagaccaggagtttgcctattcctttttttgttcttatttctttttaatttctctgttcccaccatctttaccaatccctgtacacatgtgtgtgtgctgatacatacacatagtccaatatagtatgtccatgtctattcagtaccaaaatctttattatcacatgaataaatgctgcgatatcaactgtatgtgttaagttttaagattattacttcacattaatccatgtttaatagataaggttctataaaattgctgatatttagccatattacaccttcagtaaagatcagcctgatatcttggtcttatccaaggtatctggtcattgctctgccagtcagcagcactctacgtgtgaacatatcatataatataatgagatgccattataattcttggctagtcaggatgttgcttcttagttcatttgatttgactgtatgcgtggttctgttccactagtccacattgcttgctggggttccctttaactgctcttaaaaacactcttccttttttttactgtgactaaagatacctagacttatctttttcttcattttaaacttttacaaaaaaaaaacaaaaaacaaaaacacagaaggaaacttgacttaaaataacttttgttttatacccagcaaaaagtatctgagataaggaaatgttaaggaggtctgtacatgcttagagtgggagaggagagaaaatgcttagagtgtacatgcttacagaaggctttttttattctgacccctcatcctcaaccagctcccatgtagctctcctactttgtagcaaggccagagcagagctccagtcccagtgctaatactgcgattaacccccaagccaaacccagcttttatatttgcttccaactcgtagcttttgacccatttcaggattttgtttgcctgtttttgtggagagtatttttttccctcaatttctgaaaatcaagcaaaaatataaaaagcacgttatatattagattcagttattttgtctttttttcttttttatggtctataaggtgtacaacgtgattttttgaatacacatatacttagtaaaatgattactatagttgaccaaattaacgaatctctctcctcacatagttacctttgtgtgtgtgtgtgtggtaagagcacctagtatctactttgttagcaaattgccagtacacaaaatgatattattaactatcgtcatcgtgctgtgtatgaaatctccagatacatcctgcgtaactgcaactttgtaccctttgaccaacatctccccattcctgcacttctgtagccagcattctatatatcacttctatgtatttggatttttaagagtctcatacctaatacaatacatattacagtatctgagtgtccaaaaatgtttattaggtgaatgtgtacttgactacctaacatttttttcacattataagttatatgacattttgagagttgggtttattttacttaccatcggaaatattgtttcattggatagctcatttagttcagtttacacaattgttattgaatatattttatgtgctagtttcttttgcagaaaacacatgcctgcttgcaagattggtccttgactagcatctgggaactttaatggtaaacagttccctacaatgatataaaactttaactacatgaaaaaagtggcttggtatgcctagctgtgtaaaatgtggtttaacacctggttttccttctaggagtctagagttttgctaaagactgggcagagagtatttatgtgaccaaaccccagtataaaccttagacactgaatttctgatgagtttccctggtagacaacacttcacatgtgttgtcacaattctgtgttggaggtaaagagcatattctgaatatttcacagggaaagaactcttggaatcttgtgcctgttttttttttttttttttttttttttttttttttctggtctttgccccatgcaccctttgtctttgctgatttagctttgtatcctttcactgtaataaatcatagccaggaaagtaactacatgctaagtcctgtgatccctccttgtgggtcactgaacctggagtggacttggggacgtgtgacagagctgtacatcagacaaactgaacatataagaaagagcctttcccatgaggagcttatagtcttgtagaatagagggagtaggaagtgtgtaaggggcttttagatactcaaatagataatttcaacatcatttggttgataataaccaaatcatgcaaagagtgctatgggaacaccaagaagagacactctttctaggagttcgggacaggttttaaaaatgagaaatactttgccaggtacagaaaggtaggcaatacatgccgaacaaagagacctgaatgtaaaataaaataatatcagtgataagattgatagtaatggccacaagaataacaatagcaaacacgaaatgcttactaagtaccaagaattttttaagcccttctatatattaactcatttgattctcatagcaatgctgtgaagtaggtaatattattatgtgtttttagaaaatgaggaaatgagggtacggagagattaggtatattgtacatgttcatatagcttgaatatattactctgcagcttgaacccagaaaatccagttgttactctgtgctagctttctaaagaagggaagcaggatatatttgtttaattattttattttttaattccaaacttctgacatagaaaatgctttttaaattataacacatgcgagttggaaatttccagaatgaaatatgctactattatcttggtgggaaaataagacttccaaatataaaataatagaaagcaatataaaatgtcatattcgaatatgtaatatagtctaaaagaggcaatgtatatattaagcattatttcctttatccatgtggagacttaatgatatcttcactttacctaaatccatgataaaaacatgataacacataaatgaataattgcctcacttattgaataaaatctacactctccttggataatctttaatttggagcttctctgctattacatctgacttaatattttcagtggtgaatgaattattttttttatctttggtgttcacatttatacaaacaccaaaggtacaaaaccagagtatttatatatattggtatatatgtctgaaaacatatatataaacaccatatatatagacaaactctctctatatatatatatgttttcagaccgttatgtgaaaagtggtgaaataatattatatttcattgtttttaagacattttctttacttgctatataattttttgaagttttagataaattcaggcaagtaaagtggctacctttcaactttatctccttcaatgctgtaacaaggctgaaagatataaatgaaaaagaaaaacaagctgcccatagtttaaataatatctttaggtcatttcagtattttagcattctctttgctaaccttttgactgcaatataattattaacagtaatcatttctactgcaattggaaaattgaaattttcaagtggtctaacacatatattaaaaatgacacttttatagatggagaatgaaagccagagcctgtatttgagcataattatgagattcatatattaatggagtaatttttagaaataaatggccaaagacattttaaaattataaattttttggaaaaataatggtgttatctaatttgaatagaatttactgtgatgctcagtatgttacttagaattaccatgtgattaatttttaattcccagctttttattgaagttctccaccttgttatctaactatgtaactatgttcatcatgtttattttaatatccttgtctgataactccagtatctacatcaactgtgggtttgtttctattgtcttttctgttttctggctttgatacacttggtctctttccttggtatgtctgataattgtctaatgggatgctgtctgcctgttatgtataaaaattatggaggtaatctctagatactgttttctttgtcatgagagaatttccctgttgcctccttcaaccagagagaagggatagaatatattaatgcaattcagcgagagatggagcttgtttagaattgcagtttcatcttagtaaaagttggtttaacgttggttcacctctgaaataaatatgtgtgtttgtatgtgtatatgtatacacacatatcacaaatacaaatataaacatatgtgacatgggatcttctttggctgagtagaattgatatcaacattcacagttcttgcctggggtatttaccaggaccccttctccttgatgtccccataccacatttcagtcccttcaaccccctaagaagccctgttctgttccttagccctttaccttttgcttgcgaattaacaattgctttaacaggaaaaagccataatgaatgttgggtggagtcctttgtaattctttttcctctgcgatcatagtctctcaaatccacagcttttattggtctccagtgtctttaaatggatgtaatttggattttggacaatcttatcacttctcttcaccagggacataggtctgcaaaaggtttttctgcagaaagcacagtgtgttactaaagatgcaaaatgtaaagtacatttaagtatgttattatctgtagaatttgtgataaccaattgcaggatacttgactactatacgcaaaaatactcccactcctactccgattttaacctgggagtgaataatttaatgtgcataaaagactcaacatataatggataacctaacatataatggacgatttagttcaataagtggttagatctgaattttccagtccagagcacagtctacattttacattttacaacatcatgccattcagtatctaagtacttgcgtaacctctatatcaagctccaagctttagctacaactaagtttcaacaggattcctattgtagctcttgtttgaacttaacctatttcattttttatgatcacaatcattttgtttttgtcttgtaataagtggtaacaggtaaagggcttgagtatgagtgatagtgaaaataatgatgacaaatataaataacctaaaaatgtgtattatttgcccttgactatttatctcaacttaagtttacttcttataaaaatgtcatttcttttcattcctgatgtgaaacttgccctttaacaaatgagaaagaatgccgttttatgacttcacataactcaacactatgaattactacaaatatacattaatatacgatttcctcagaagcctatttcatgtagctttgcaaacaaatgagaagggcacgctagaggaattagataatcatttagtagcagttctaacttacagctttgacataacactttaacaaaacaatgaagtgattgagtcaagaaaagtagttatactacaaagtacactctcttaaatatttggttccaaatttcagatgtgagttattattaccacagcctgtaggcactcatttaagtattcttgccttttataaatggtttgtgtgaatcagttctatgagaaaaacattcttcctcgttaccacctccaaaccacaaccatccatccattagtgttaaggggccatatataggagggatggtaggtgggaagtttgactctgaattcattactgtatatacatactgtaaaagtttgacttctaattttagagcttttcggaaacttgaaaagtcaagtagcgtgactttcactgttgacatgtataataaaaaaatcctatattaataattgtttgaggctacttgttttctccgacagatggtttctttttttatgaatggattaataccaccattctttatttctatttcaccatagttatcatcattctccaagttcaaggataaaaacttgaagttctatataaatcttaaattattatttgcttttgtatttattcacatgccaaatacattctaagaatttaatatattcttgctaaaataaatgttttgctttttatctctatttgatgtgtctatcagctttagtatatggaatttgtcataggcacatgagaatgcatttggtgcactagagcattgatatttaactatgctttgcattctgctcttcacacatgttcctactgacatggatacaaaaaaatgcattgattgtgggactaagaaatacagaaatagatgctagccaccaagaatctccataggcagagaagaaataatatgatttagacaaagtaataatagtcatcattatcataattatgttcactaagatatgttgaatggttatgaaatgccagtccagtctctgttctaagtgcttagaattcctgacatcttagcttcacacaaccaagagtgtatagcagaagtgagagtaaactgggcatttttcagggataaaaagtcacatgctaaagatcaagactgaaaaaaaaagaaaaaaacacatgcagtcttggtccaaacgtgttttagaatgtgtgactccaagtcatgatcttttgccatttaagcaactactactcacactttggaataacaattttatttctatgattcattacccatttaagtatataatttgacattacctatgtcaaaatgcattcatttttccataataaacatggttcttattttcatgtgcctaatctgggaggtgacacctgctgccagaggagcttccattcaccccttcaacttggaaatgccctgaaaaatttaaaataattttcagacactttattatgtttatagctcttagcaaataatgaatagaaacaaacatattgagtgttcagcaccatgaggaatagaaaatcaataggatgcaatttctgtcttctggaaccttacaagataaatgaatgaaatactacaggtaaataaaaacaaaattggctaaattttaggtaaggaaaatggaaagagtggaagcttggggaaggaaaaaattccctcttatagagcctatgttctcagaatggagaaaaatatgaatttccaagacctctaataattaaccactattctcaaggagtcgtgtaaaagaatgaactctttcttcacatctcaatgaaccaaccagtgggttcttagcttcttttaccctggaccggacacattaccagtcctaatctttaatattgaatccttctcacactgccaaatacgttatctgcttctttctcttccctgtttttgcagtagcgtcctcctcaagctgtacatttaaagcgtgaaagtaactcatttccagagtaaacctttgtcttttccagactaatgaaatactgcaaaaatgaaactcttcctgtgccctaagtttcccagcttcacctggcacaaaggagtggggttggggggaggtttgcgtaaatctactgaaatttggagaaaggttttggttcttacatggaaattgatttgtatgctgatgtatgctaatcaacacagcacaattctctaataatgtgataattattatgctgactcaggctaaaacgttagcccttgtggcatgtttatcttgtcctctggcaccagtggtgtaaaagaatcgtattcaccataactctagtgaatataatgaattttaaaaagtactgttttgttttgatgtaaagacagatatatcttaatgaaaaagaaaaataattgctaggcagtggatttggggttgacttcaatagggataacttaaataatgcgaataaaacagtaattaaaatataggcaggtaaactccctccagcactattttaatgatggacactttccaagagggttcttatctcctcagagcaaaggctggaagcaccttttttcacccttagacagaggatgatggcatctcattttggttgtcaggtgcacagtttaggagaaaaacacctctggaatatacaaaacattctgtttgtcagaatggaaaaatactgcatgtttaaggatcaactaagagattttttttctgaatatttgggacaaagcacattttagaaattaagacctcttgatgaactttagacaaaaggaaacatgagtatttttctacctattatgttaaactgacgccaaaggtaagttgtagcatctttcattgtttgcttttaatgagcacttaggcatagtcttaagtcataaccattttgtgatgttctattttgagatatgtgttcttatgggcacagagcaagttatatacatgtttatgtactcttttctgctatagcatgcttgaggatgtcatctgaactagcttagtgcctcagcagctcctgtacctcatggctactgaccatacaagcactacaatcttaattccagtgcacagtaccctggaaagatttgaatgcaggggatttgttacaggaacccacatttcaccttcagtgtttcctccagtggggaaactccttccattcaatcatttaataggcagttctcgatgctggctatgcacatgaatccccagagattctgattaaattggtcttgggtgaacctaaggtgttagtattttgtttaaagctcctcaggtgaataaacatacagcccagtcagactaccccacattaggtgatttagggaaaccccattcactcatggcaggagaagacagcatggtgactcttaggggcctttgtatctatcttctctgtagactttgccattctacttactataactctatgaaaaggaattgccaaatctcatcttttaagtcttgcttaattttgggtactggttcttgctttgtgttgttttcactgccttgtacctaatagttcaaatttcctctgctttcctacttgtgactgcacaatactcaatcagtaattcaccttggcatcacatcttgcaattctaagtcaacctcttctctaagccaagagaggagactggattataatccatactacactacacatacaggcacggaaatattgtttgcattttaccaatcacagtgtacatccccaattcaaaatactggaaacactgttaccagcaccctctccaatgatccagtaatgcaataacaaggcatcagcatttcagcatataaatctttatagtacatctttgactaaaaaaaattacatatcacttaaacctagatatcatggctcatctctgttctttcttccctgtatttgtgattgtaattacgttggctataaataccttttatcaaaaaaaaaaaattgtttttaaggttgtataattctgttatgaaaaattctaaattttcatggataaattactattaatgaatatggttatatgcattaggaagctaatttggtaacaattatttccatatgatagcagaaagtgttggaaacaaaggtaaagtaatttgtcaatcaaaatatatgaataggttgaaattttggaagcaaaaactatttatgctctatcacttgcattttgattgttccatatggttaatgagactcccctgccctccacatttggaagagctttatttaaaacaaatatgtagtcactaaaaatacaactaaaaatttatgtcaggacagtaatattcctttttttccagctattcttgtcaaagcaacctaaatccccaaaatatagaggatttaaaatgtgggatttaaaaatgtaaacaggggctgggcacggtggctcacgcctgtaatcccaggactttggggggctgaggcgggcggatcatgaggtcaggagatcgagaccctcctggctaacacggtgaaaccccgtctctactaaaaatacaaaaaaaaaaaaaaaaaaaaattagctgggcgtagtggcgggcgcctgcagtcccaggtactcggggaggctgagccaggagaatggcgtgaacccaggaggcggagcttgcagtgagccgagatagcgccactgcactccagcctgggggacagaccgagactccatctcaataaaaagtaaacagtaagttgcttacttgtcaaacagtttttaaataacacagcagcaacaaaagaacataaatattaatactactactacgaattaacttagaacattctgataatctgaattttcacactacatggtttcagtagtaatgatattaagatttcttgatatattttagtgggtttgtagttggctcaggtttattatagtccgttagagtgttatattgtcatctctataaagtggcatcgacgcacatgaaaacctttaatgacttcacaggattaggctgttgcagttatgatgatagtttctgcccattactttcactatttaagaggaagttccaataatattttcaaattgagctagaaggtaatcactgcggtaaaaaccccaggctaagttgaagaggttatatagttttgctattacaattctttgatttgaaataatagaaaccaacttctcaaatcatgaagcaaattaataataagggtacaaatgcatagccttgaatccagaggctgaaattcatgtaggcctcagttagctaacataagcaggaaaaatcactggaacttttcatccttcatgtttattcctccctgggttgtctgttttaatgcctatttttgcaaacaagcttcctcttctactctgcctacttggtagctgtgacttctacctccctatgttttgtatatggcagcctagtcatatacaaaatcaagagattaagaggctctgggaaagaagagcatctggctgctacagctttgttcaaggacatactcttcactagggatggcctggtgttagtgtcactgagcattgacttccggggcttagacctgtgcatgaggaagggggataagttgaacaatgtaaactctcattgggcatgtgcaaaaagactaaatttaaatttgtgcatgaggcttagggtagtacttactgctaaagattcttcagcctaggggcatggacttcttcttccagcccacctgttattcccatgggcacctatcatctccttccctatatttgcacagctaacaactatcttgctacttcctgctgtttaccctgaaaccctgatttgacatcttccgtataactccagggctgcaccaacatattatctacattggttaaaaagaaaagttagtgggaaggggaagaaaaagtaggctgttcctttttcttctgactttcaactctaaccaacactgccacatcagcagacgtcgtacaataatcatgattggtaattatgatgatagtagttactgagcattccctatgtgtactagactaggctagtccttatcttgtctcatttaatacagataacaaccttatagatagacactcatctccattttatatgtaggtaactaaagctgggagaaatggacttttcagaggggctgtaagtaataagcgatgaagctgaaattcaacctcaggcagtctgattctagtccagtaatttttcacagaaaagttgggaagtgctgcaaggctgcaggccgccagcacgccttgcatccatcccttccccattccacccatccctcatttcagaaacttgtctcaaaactctttaggcccatatagtgattctttagggtagtccatttggtcccaccgtcacaccatccctttcatgcaacactaactttctctagggagggtatcaaatggataaatatttatcctccctctgttcttgcactgtcatcatcatttaggaaatcaagaaacaagaggaatgaaagggtcttgttttgcattaggtcagggaaataggcagtgagagtcagattctggtggaaaggtggcacccctcgtgcaaacctcagagttcacaaaaacaagctaggaaagtcagttgaacctttgtcctgtcccaggtcatggggatctcatgaatgattagtggagaagcccgcatatcttttgcaggcaaatagagggaataaggacaaagcatagcagggctagatagatgcttggcattcataaaactttgtgacccatgttgattgggtaatatgcttaaagtacattattaagtgattagaattcgggggggtgttgaatttagaataagtctaaccaatttcaatgggacaatggggattaaatggaatctatttacatatgcattttgggaatgcaactcatttaaaattgaggattccttatgtgactgtgaaatttgaatgactgggccagaattttgctgaaaagtaaaaacccttttaattggcacaattatagagaaattgaagtgtcagaatattaaggcctgttggaagtaaatgctcagtgcctcaaagtgaaaatagcactcaggcaaatttttctcagcaaggcaatttacttctatagaagggtgcatctcgaggatggagaaatggcgagagcacactggacaagggagggaaagggggtcttatccttaatgcagctagtccctactactgtgtctttcccctattggctagggttggactgcatagtctaagctaactccaattggctattttaaagagagcaggggtacgagccagagtggcagggtgagtagtttcagtggaaaggatggttacagagcagatgactaaggtcagagcaggtgactaaggacagagcaggtgactaagggtgactaaggacaaagcaggtgatagaggctgggagggggttgtttactgagactaagggcaaggagacataaaaaacaaggaagttaaactttaaaatggagaacaaagaacatggaagctgaatatatggacatattggttcttagaagaggaatttatggaatccttcaatatccctttcaatttttatagtccttcctcttcaaacctttttaacatgtcttggctttgttgttcaacttgatcctctaaaaggaaaagcttatctgaataaagtggaggagagctaagggagggtttagtaagtgctgtttctataagtctttgcactagcccacggatgcatggtatgacacaacacccaacaagaatgagtacacctgttatggctgtaagagaagtaagaattgaggctatgattcctttctatttactgaaccacctctctagccatcttaagaaagggttgtcgactccagaatttttagttaacttattagataaagcagtaagtccttgtagggcccttgttatgttcccatcaagggcagtgttgtttgggatgagggtacaacactgagttttaatcataacaaacactatcttttttggctaatatcatttctgtggccattctattcttccaggccatctgtctagtaggccccaattgttctgctattcctttgacaacatccctgatgtaattgataaatcgctgttgattataatagatgtaatttatccaatctatgtttttattgatagtcaaccaccaaaatattgactcaaatcctgcagttatttgatcccaggctttaaatttatgtggtacccttgtgagcctaattgtatctaaataaacgtgggagtggaaagaccaataaggggcttcccttggtttacaacgttgtgtttttcctttttctggttgatgaaatgccagggcaaaagggatagtcaattggactagagcaccagtgccactccagttacttggcagagtgtccagtaaaggtccaccacaatactaccatacatctgctcgggggtgaataagcgttgactgattgttaagctcttggaaagtattcagctcactgtatccttttatgtctccaaggaacgctaagttacctacttattgtgagagacacgaagtgaacctagtgtcgggaggcggaagctggatggccctcagtggctgacccgcagagtgttgaattttgggatatagcagagagagaacttgacacgacttgttaccccaggctgtggaatcttggaaaagagctactatacagcccatgtctggttgactgaaggaccatcctagtggaaagcagataatctgggcttctggtctgccattcacacaagcttaacaattgcttttgtttaaagtgcagacagaatatttgatccattccaaccaggcattcacatcttgataccctgtctcagttgccaaagtttgttttaggtctttaagttctataatagctaccttggtcttgtcattagatagagaagaaacaacagtttcattgtgagaggttttggaagaaggcttaggggaaggtataggcagtaggggagcaatgaagtgtatttcaaaggatctgatagggtctgttcctgaaacctcagcccccatcccataaaaccagcttaaataaaggaaccgacttagagaagaagaactttgagggtttgagataataacctgtactggattgcactggttgagctgacagttaggggaagctgtttctttagtaaaatgaatgtgtggttttaggaaattacaactgctggttgtggcagtccatccttgcactttagtggtccacagaatgttggaccaactacagcataaaagctctgtatcggggggcaagactcccagttgacactggggtcttcactgaaaccttcccagactaaatgatcctgattcactaatctccagcctgaggggagtcaagaaggacagaggtatttttctgaagtggaaagctgtctttgacttggtaagtctctatggggtataacaaggcaagaatcaaatgtaatagtttgaggcaaaattgacctggttacattaataatgaggtggtcagcaatacagcaaggaaaggaggagtaatagaatagatgaaagatagttaattttttcttagctttagtttggtagggttttcacctgggactatggcccatgactctcgtgtgggcagtgctttcttgactcgggtgtgatgggtccatcctttttctgctgttgagactgcggtttcagtagttaggagcactaggtaaggtccttcccaggccaattcaagcttttcctccttccagcttttgatgaggatgtgatccccaggctgattttgatgtactgggaactccaggggcagtgtctgtgctaggagacctttggttttaagagaagagaaagtagaagataggccaagtgtataatttttaaggaattggttttttgtttcaaaggtaggaatgtcaatagtggagcgtaaataaggcaatccattgagcatctcttaaagggaaagaccaatatctttctgaggggcagttcagattcttaacagggcaataggaaagcatttggtccatggtaaccaagtctccagaaccaacttggttaagcggttcttcagagtttaattcattctttctattctccctgatgaaggtgggtgccaaggagtatgatattcccatctaatgtctagtgtttgggatagctttttagtgatgtgcgcagtgaaattggttccattgtctgagtcaatattttctattagcccaaatctggacactgtattttcaattaacaccttaactacattattggccattgcatttgaaaaggggatagctttgacccagtgaatgaggtgatctgctatcactagtaagtattttagatgacctattgaaggtatctctgtgcaatcaatctggatactttgggatagccttaagcctgggctccttccccaaaggggtattctttttagttttcttacatactatacaactgtctgtaacctgtttggccagggtataaattcctgtgcaccgataaactctgaggactgtatcacacatggcttggggcccccaatgggtcccttgatgcagttgggacaagacttccctcataagggatttggataacgtttctgtctggtctggcagtatccatttttcttctgaattctctttagcatctgtttttattagtttttcttttttagtggaagagaaaatggggatcatggtaggagaaggaaggtaatgagttaagtcaaaaataggtgttttagaagaaatggcagcctgtttggctatctgatctgctaggttatttcctcgactttcacaagaaagacttttctgatatccagggacatggacaatacctattcttctggcaactgcagattattaaatatttgggtgattagctccttatgaaaaaggtcttgacttttactactaaagagacctcattcagtcaaaattttccaaatgtgtgagccactcaacaggtgtactgagaattggtatagatggttccttcctggttctgaaagtactttaaggcttggctgagtgcaaaccgcttgcaagtttgggcagaccaattatgaggcaattttcctgactctatttcttcgagagtttctccatcaagtactgaatacccattgtgtcttttttcctcaatcacccgggaggaatcatctataaataactctcgtcccgtcctgaagggagtgtctcctaggtctggttggacttttaaatgataatcaattaaatctaaacatttgtgctctctctttagatttggatcccctgttaggaaacctgctgggataagtgaattatcagtggttaatattaacagaatagcctcatactttaagattcttgagtcagtaagccactgccctgctttctggtttaagatagttctaacttggtggggcatgcttactgtcaattttcctccaaaggttaactttctactttctttactaatactcctgtagttgcaatggattggatgtattgaggccatctacaagtaactggatctaagacttttgacaggaagaccacaggctaccaacagcctctgtgtccttcagtaagcacttctaaagttactccattatccacgttgacaaaaatgtggaatggctttttagggaaggtaaggctaagacaagggtggttatgagcctttctttcagctctttgatctgatcacctttctcagaagtctacaggagatggtcaggcttcttctgggcaagtttttgatataaaagtttattgtttagtgcatatgagtcaattcataagtgacagtatccaactaaccctaaagatttcctgagtttttatttagtttgaggcaagggtagggatacgattccctcaacttatttaggccctatttttcacttgtctgcactgtggcctaaatatttaacttcaggctctacctactgaagctttccgtttgagacttgtaacccttcgaactgcagatggttaagaatatgtgtagagaagctagctactttctccatatcttcaccagatataagaatatcatcaacatattggagtaggcatatttgttttgggatgatgactttttctaatacttgttctaaaatttgaccgaaaaggttaagggagtctgtgaacccttggaataagactgtccatcgatattgttgttttcaccctggatggagatctttccactcaaaagcaaatatatcttcacaatctttagccaggggacatgtccaaaaatcatccttcaaatctgtaacagtaaaccattgatgattatatggaatcttgctgagaatggtgtaaggattgggaacaatggggtgggtagtttggactatttggttaatggctctaaggtcttttaccagccagtatgacccatctgatttcttgacaggcagtattggggtgttataagaggacatatagggctcaagaagcccatctttagtaagaccttcacttataggttttaaccctatcctgccctctaggggaatggggtattattttctccttactacttccccgggggtttttagcttgatgtggattggagggactcagagttttcttcagttcttttctttggaccagacattagaattaatgtattttgtctctgtattggtgagtaggtttaatgaggtgaagaattctcttggtctgacttgtaggcctctgcctaacttcaacattaaatccctccctaataaattagtctctgcttcagggattaacaaaaactgaatatgagctgattgatcttggtatttgacttttgtgtattttaaaatttttgttttaaatccttcacctttcactccagagagcaaaagtccttccaaagagtaggcaatattagatggggggaaaccaacagaggaacaagtcatccctgaatcgaacaaaaagtgataaattcatgtttaggtcccacttctaaatttattaagggctcctggtgggactcaacataaaagagacagagcccctgactcccttattcttcctcaaaagtaatgaacggaaggacttttttctcttttttgaattcaggacatttcctcttgaagtggcctgtactttcatatttgtagcacctatcttgtcctttgtacctctcagttctgggatttttttactttgttttgccatactcttcagagggccttggtcctccagatggaggcttaggtcttttaaagaagggtttggaccctttatagtttctgtgtctctggaagctctgtttagaaggacatggatttggagtcttctgttggaaggtggataatgtaagttttgtcttttgtttctgatttttttcgtctctcctcacacataacttttgagtttccatgcgaagttcactcgggggacggtctggtctttccaattttctatttttttgtactttttttgaaatgtctggccaactttttgtgaaaaattggagttttaacatttctcatccaaagggatcttctaaattgaggcctgtatattgtctcatttgttccttcagtctgtctaggaatttcataggccctttatcctttttctgttgcatattaaatgttttagaaagattttgggtttggggtactgattcccgagttcatttgattatcacctcccttaggccctgtgtattttcctggtgagttgtgttgttattgtcccagcgggggtcttgggcagggaatttctggtccatggtaggaacgttttgactgggtgaatgctcacgttctcaaactactatagcagccctatgaatcatactcctttcttctcctgaaaagaggatgtccaaaatggacattaactcaacccaagtgtataactgaggtcctaaaaattgatcaatttgatctgccactccgtaagggtcatctagtaatggcttaagctccttttttaaactctggaattctgaactggttaagggagtatccatgaagtcaatggttcctcctccttgtggcacctatcttaagggaaggagatcaggggctgactctttagttgtagagggaaaagggaagtttcggatatcctttttatattgttctatttcacattggagtccctttagggaggggtccttaggctgttaggggacagactcttgggatgataatttccaagagtcaggattgtaaggagggggaataacgtgagtaggtgaagaatctggagcaggatcttgggcagcagcagctgtctgaggagagggcttggggtcactgagcaggggaagatggtctaggggatcccatatgctggagtctttgcgcatgggaactaacttatgtaatttttccttttgtgatgttacattgggttcttccctagttgtctttaaggggaaaaggacaggtctctgcctccaacaaagagcatagtctagttcctcttgagaaacgaggcttttatcatttacatattgaatgaaaagctgacacattacatcttcattcgacccaaactttggtcagaagatttgagggtttgaagatgggtctctgagtccaaataaaacagcaatattttatcatttgttgctttttcttatgtttagtcctctcattatttttccagtattttaacatgagacctaggggactatgagggggaatcatctttgttggtatttttatcctttttactccctgtcttgcttagggtatttcccatgttgggtcctagttaggcttaatccctcatactagagatttcttgcctatcttttagccccacctgctggaggatccttgcacccttcttttgcttcatccactctggccgcttcccttttgggtgtctaggcccctcttggtattggcatgccagtttgaaccccatggcaggatctgtcctaagccgtatgaggtgaccatggaaccgcagataggacccactcactccacacagcggtagtgcgtagtaccattcacacaagcagcactgcaagcagtagtgtttgtgatcatttaaacacacttttaacctccagaatatcttgaccagcaaggaaatacttcgtcacccctgcgacattgcttaacttggtctgtgtacagagttacctgattgctgcggtatgtgagaatcctttccccaagctatcatcctgtttccttctgggttgttgagagcccgagtttatttgtcgcactgggtggttccccatctctcaccctgaggccaccacaatgaggcaatgggacgcgtctccccacgagaagtgaatggagacccattccctggaggagaatgggaatcccgggcaggcgcccaaaattgttggaagtaaatgctcggtgccacaaagtgaaaatagcattcagacaaaagttttctcaacaaaacaatttacttctatagaagggtgagtctcatggatagagcaatggagagagcacaccagacaagggaggggaagagagtcttatccttaatgcagttagtccctactgctgtgtctttcctctattgactagggttagaccgcacagtctaaggtaattcgggttggctattttaaagagagcagtggtacaagctgaaatggcagggtgagtagttttggtgggagggatggttacaaaacaggtgactaagtatgactaaggacagagcaggtgactaaggacagaacaggtgactataaggatgactaaagacagagcagatgactaaggacagagcaggtgactaaggacagagagggtgatagaggttaggagggggttgtttactgaaactagggacaaagagacgtaaagaacaaggaagttaaactttaagatgaggaacaaagaacagggaagctgaacatagtgacatattggttctttaaagagaaatctactgtatcctacaaggccttagtgcagaccaagttgcattacttctgtggtatggcaaacagtcctaaaataagcagatataaaacaaacaaaatcatacagcatgttttctattaggaatacaaagggaaagcaaacgtaacatgtctagtccttagtaaaacctgggtgacaaaagagaagagtgaaaaagggcagcacatcattgtggtatatgtttcttatatatgtttcttaacgtcctttcgttctttacgtctcttgtccctagtttcaataaacagccccctcctaatctctatcacctgctctgtccttagtcacctcctctgtctttactcatccttatagtcacctgttccatgcttagtcacctgttctgtccttagtcatccttagtcacctgttttgtaaccatccttcccaccgaaactactcacctcaccattccaggtcatacccctgctctctttaaagcagccaattggaattaccttagactgtgtggtctaaccctagtcaataggggaaagacacagcagtagggactagctgcattaaggataagacgctcttcccatcccttgtctggtgtgctctctccattgctctatccatgagactcacccttctatagaagtaaattgtcttgttgagaaaacttttgtctgaatgctatttttactttgtggcactgaacatttacttccaacaattttgggggcctgcctgggattcccattctcctccagggaacaggtctccattcacttcaagtggggaagagcttcacatacacctttattttttattttcattaatgtcactaattcacattataaaatgatggtaaaacatttacataagtgctggactgcagttcaatgtgtttttaagtgcagaaacaaagttaccgtctaaactaaattttgttccatttgacgtaaaaagagaaatatctacttaaagcaatctttcgttttataggtgaatgaaatgctaatcacaaataattctcatataatcagtaaagaaatcacttataaagtcctataagctgacattttgtccagctcaagctcctgtttgtacttaaaatattaaaattataagtcttgaaactaattctaactggaggatcctgcttgtttgcagtctctgcaaaacagtttcaatatagtatatttcaacttcctttcaagacggagactatatttctgttgttgaagcaattaggtgcatattttacctacaacaatcaataagtagacagtctgtttcttatactcttcttccaccacagctaggtgttagacaaacacaagtcattcaggcatttttaaaagacccttctttctgttgctatgtcctctaatttctgatttctgcctgggggagcttacagcaagtataactctcttttgtggtggctagggaagctaaaaaaaaaaagttttgcaaaacataaaataaaacaccctttttataaaagcaaggtgaaaagttcaaacatccagcttcattggcaaattgtgatttggctccatgaaagtaagtttactccctgattcagtgagaagatacatactgatccttagtaactgctttgcctgtggcatgtgtgataatcacattatgtagaccattaatctgcttccgggtctatttgatgtcaatgactcagttatatttatggatggggcagatctcagttttaccttttaaagttacttaaagagaataagcataacaatatgtattagttttctattgttgccataacaaactagcacaatgttagtggcttaaaacaacactaaattatgttactcttctggcagtcctacatagtctcactagtctcaaatcaaggtatcagcagggttgcattcctttctggaggcttttaggaggattggtttcattgactttccaatttctagaggctacccacatttcctgactatgaccccctttctgcatctttaaaacgagcaaaattcatcctctgacaatcttttgttatatatctctctgattgcagctgggaaaaagtttccatttttaagaactcgtatatttagactgggcccatgtgagtaatccaggataatctccccatttaaagatcctttacctatggccagctgtggtggctctgcctgtaatccccgcactttgggaggtcgaggcgggaggcttgcttgaggccaggagtttgacaccagcctgggcaacatagtgagacctcatctctacaacaaataaaaaaaattatccagtatctgggcatagtggcatatacctccagtccaagctacttgagcactgagatgggagaatcacttgagcccaggaggtcgaggctacagtgagcgaagatcataccactgcagtctagcctgggtgacagagtgagatcttatatcaaaaaaaaaaaaaaaatttcttcacctgaataacatcaaccaagtccctttggccatgagaggtaacatattaggatatgaacaacttttcttgaggggaggaaggggtggcataattctgtctactatagaatagtttaggacagcaatatccagagcaaattaaatgtgcaaatttatttttggtagaatttttttctccaattaaatgagtttctttcagctctttccctgaaaggtattttgattttcattatatttcattcttttgattattttcacttaatagatgtgaaaattgaagttcataaaattatcaaaagtcatgcttcaagatgtaggaggagccaaaggctgcatcaggtgttgggttcgaagagtctttcctccagtgacccattgttctccaaattattcacaagagaacagacaaaaaagtgatgtcctagaaaatcataggccagtctctcaaccagaaaacttctgggaatgctatttttaaagtccttaacagatttttcttactgaaagtcataacaaatgtttcctctagaaaaaaatgtttctattgaagtatatttgacaattgaaaattgtatatatttaagaagtacaatttgatgatttgatatacatattcattgtgacataagtgcaacagccaagataattaacatagccatttcttgagttatcatttttgtttctttttgttgtgagaacacttaagagctaacctcttagcaaatttcaattatacagtaagttgtttattatagtcacattggtatacattaaatctccataacttattcttgttacactgaaactttatactccttaacaggatcttgctgtttccccatctatccagttcctagcaaacactcttctttctgcttctatgagtttgattcttttagatcccacataggagatcatgaagcatttgtttttctgtgactggattatttatacatggtttatccacgttgttacaaataactggtttttatatttttttgcaatgtggaataatattcagaaaaaaatattcataaaagctgtgcaacattccattatgtatttatactacattttctttattcagtcacctgttgatggacacaggttgtttgcacatattggctatggtgaatagagctgcaatgaatatgggggtgcagatctcttgaaaatcttgatttagttttgtttttatatagtcctagaagtgagacttctgggtcatagggtagttctatttttaatttttttagaaacccacatactgttttccatcatgtttgtacattcccagcaacattacccaagggttccctttcttccagatctctctgattatagccactctaacagatgtgaggtgatatctcattgacattttgattggttatccctgataattagtgataccttctcatatacttgtaggtacctgccatttgtatgcttcttttgagaaatctctatttaggtctcttgcccattttttggccgggttgttttttagctattgatttgtatgagtttggtttcgttttgtttacttccccctcccaggtttattgaagtgtacttgacaagtataaatcatatatttttacagtgtacaaaatgatattttgatgctcatatacattcgaaatggttgccacaatcaagttagttaacatttccatcatctcatagttaactttttttgtgtatttggttagaacagctcagttctactctctgagcaaatttcaagtataaaatacatttttattaactatagttatcatgctgtacaataaatcttcagatcttattcctcctgtgtaactgaaactatgccttttaaccatcatctccccattctgccccctatcctcagctcttggcaactacaattctactctctgtctctatttgtttgactgttttggatcatgcagtatctgtcctttagtgcctggcttatttcacttagcacaatgtccttcaggttcattcatgttgcaaattacaggttttccttcttttcataaggctgaaaaatattctaatattcagtattctattgtatgtatatatatacataatatattttttattcatttatctgatgatagacacagattgatttcatgtcttggctatcgtgaatatttcagtaaacataggagtgagatacgtcttcaacatactactctcatttcctttggatatatattggatattaacccctttccaatatatgtacagtttgcaaatattttctccattccatagattgcctttacatgctgttgattgtttcttttactgtgcagaagcctttcattggaaggaattccatttgtctagttttgcttttgtaaaatgatacccaaagttctgtactttgggaatcatttcaaaataatatcattgcccaaatttatgatttgcctaaacaaaaaagctttttcctaagttttcttctaatagtttatattttcaggtcttactttttaagtttactattttgagtttatttttgtatatggtgtgagataatggtccaattttattggttgtgtttgaatatccagattttccaacatcatttattgaagaaattatcctttctccattttctgttcttggcactcctgttgaaaattggttgaccataaatgtgttgatttatttctggtctgtattctattccacgggtcttcatgtgtgttttatgctaataccatactatattgattactatagctttgtagtacagttggaaatcagaaagtgtgatgcctctagcattgttcttactgttcaattgttttggctacatggtgtcttttgtgcttctacatgaattttaggactgtttttctgtatttctatacataaagaatgccattaggattttgacagggattgtaatgaatatgtccataactatgggtagtacagccatgttgatagtattaattcttcaaatcccatggaacaagggacttctttccatttatatgtgcctttttcaatttcttttatcaatgtttcataaatttcagtttagaagtctttcactttgttggctacatttacacttgaatatcttattattttgtttctactgtgaataagattatttccttaatttttttggataattcattattagtgtatagaaatgaaactgattattatatattaatctcattatacaataatcagtttcatatctatacactaataatgaattacctaaatacattaaacttccctatacaccatgtattaaacttcactgaatttgatgattatttctaacagttttattctggagcctttagagttatatatatatatatatatatatatatatatatatatgattatgccatctgcaaacagagataattttgcctatttatttccaatttggatgccctctatttcttttgcttgtctaatttctctggctaagacttctagaactatgttgaaaagaagttgtgagagtgggcattcttgccttataccagatcttagagggcaatctttcaggttttccccattgcttatgatgttagcttcaggcttttcatatatgtttcttatattaagctgcattatttctctacctattttgttgaaagcttcaattacaaatgggtgttgaactttgccaaatgcattttctcagtctgttgagatgaccatgaatgcttttctttttattttggtaaactgttgtataatgctgattaatttgcttatattgaatcatccttgaatctctagaaaaattcccacttgtcatggcatatgatcctttaatgggcttttaatttggtttgctagtatgttattaaaatccttaaatccttaatataaatagcaatataatataaatgtaaatataatatatatttatatttataaatatttaatccttaaatccttaatataaatataaaatccttaaaaataaggatttttaagtctatgtgcatcagggatatggacttctacttttcttgtaggatttgcatggttatgttatcagagtgatgatggccccataaaatgagtttggaagaattatttttggaagagattaaaaaggattagtttcagttcttttttgaatgtttgatagaattcaaacatgaggccataagatcctggggctttccttattggaagatttttttaccgattcaatctccttatttgttattggcctctcagactttgtttcttcctgattcaatttttgtagcttgtaagtttctaaggatttatccattcattttaggttgttttagtttgttagtgtataattgtcatttacagttctttttgatctttgtttattcctgaggtatccattgtaatgtctcctttttcaaatctgattttatttatttgagtcttttctctttttttcatagtctagtctaagggtttattgattttatttatctttgaaaaacccaatccttagttttgctatattttcccatttttttgttctctgatttgcttctgctaatctttattaatttttattatgttaatttagggtttagtttgttctttttctccactgattatttaaagtataaaattgtttatttgtggtctttcctatttttaatgtaggtgtttatcattataacatagtctgttattactgcttttgctgtatctcacaagttttggtaagttgtgttttattattcaggttttgagatacttttaaattttcttcagtttccactttgacccaatggtgtgttgtttagttcctacatttttgtgaatttttccaatttcttcctgtttttaaattctagtttcattacatcatggttagaaaagacacctgtaatgattttgatcttcttaaatgtattgaggcatgttttgtgacctaacatatgatctatcctggagaatgttccatgtgcacttgagaagaatgcgtattttgctgctgggttagaagttgtgttatttggtatgtattattattcaagtcatatatttattcactttctgtctggacgttgtgttcgttatcgaaagtgggatattgaaatctcaaataatattatattattgtttgtttctcctcagtgtttgcattatatatttaaatgatgatattgggttcatttatatttacttttttttgtttttttttttgagacagagtctcgttttgtagcccaggctgaagtatagtggtgcaatctcagctcactgcaacctccgcctcccaggtcccagttcaaacaattctcctgcctcagcttcccgaatagctggggttacaggcacatgccaccatgcccagctaatttttgtattttagtagagacagggtttcaccatgttggccaggctggtcttgaactgctgaccttgtgatctgcctacctcagcctcccaaagtgctgggtgggtacatttacatttgttatatctctctgttggattgatccttttattattgtataatgaccttctttgtctctggagacagaattagacttaaagtctatccatgccttctttcttttagttaccatttacaggaaataccttttcaatcctttcacttttagcctttgtatgtctttgattctaaagtaagactcttgtagacagaaagtaacttgatcctctttttttttccatccattcagctattgtatactttttgattggtgagtttaatccatttatatttaaggtaattatttgccattttgttaattgtttggggttttgttttttggattttgtttttttgcagttgcttcattcctctcttctgcttttgtctccttcctttgttattgtgtgtgtgtgtgcgtgcgtgtgtgtgtatgtatgtatttatgcgttttactgtttttcttttctctttatcctttgtatacctattacaggtttttggttagcttgaggcttgtataaaatatctggtagttgtagtcttctattttgagttgaaaacgattcagttgcatacaaaaacactcctcttatactccccaaacccccaacactttgtgttcttaaaggcagggattgctttcttttatattgcatatccattaacaaatttttatctatgtacccccttatctgttggagatatgttccaagacctatagtagatgcctgaaacgatgaatagttctgaactctatatatactatgtttttcctatacatatataactataataaagtttataaattagacacagtaaatgattaacaacaataactaataataaagtacagcatttataatgatatgctacaaaaagttatgtgaatgtggtctatttctctctttctcaaaatattttattatactatacccacctttcttcttcttgtgatctattaatctgattatcaaggcagctaataaatgactaatggacaggtagcctatatggcatggatacactaatcaaatggatgatttacattttgggcaatatggagtaggatggtgtgtgatttcatcatgctaaacagaagagcatgcaaattaaaatttatgaattgtgtatttccggaatttcccatttagtatattcagactgtgattgactgtgggtaactgaaaccatggatagcaaaactgcagataaagggagactactgtattaccttttatataaggattaaaagtaatttacacacctttgtagagttacattaatccatatatgtttatatatctacctttgcttgtgagatttatgctcttatattatttttagagcatttttgtttaaatttgtagaactcttctaatcatttattgtaagacagacctagtggtgacagttttcgtttgtctgggaaagagtttatctctttttaatttttaaatgataatattgctgaatatagtgttctaggttggcagttatttttttctttcagtactttgaatgtataatcttactctctcctggcctatcaggtttcagctaagaaatctgctgatagtcttatgagggctcccttataaatgtcaaatcgctttctcctcctcttttaaaattctgtttgtccttgactttagacaatttgattatgatatttgggtgaagacctcatgatactcagcctgtttggggttccttgggcatcatgaatatgaatgttcatttccctcaccagatttgggaagttttccataatcatttctttttcttttcttttttttttcattttttttttttttttttttgagatggagtcttacccttttgcccaggctgtagtgcagcggtgtgatcctagttcactgcaacctctgcctcccagtttcaagtgattctcatgcctcagcctgctgagtagctgggattacaagtgtgtaccactaggcctgtctaatttttgtatttttagtagaggtggtttttcactatgttggccaggctgctcttgaactcctgacctcaagtgatctgcccacttcagccttccaaagtgctgggattacaggcatgagtcaccatggttggcctagttatttcttttacataagctgtctggccctttatctttctctgttactttttagactcccagaatgaatatatttattcacttgatagtgtccctaagtcccataggcttttttcactctttcattcttttctctttgttctcctctgactgggtgatttcatatgacttgtctttgagtttgcagattgttttcttctgcttgattgagtctactgttgaaactgtctatggcactttttcatattattcattgtaaacttcagctccagaatttctgattggttcttttttgtaattttcaagtctttattgaggcttttgttttgtttatatattatttttctcatttcattgagctatctgtgttctcttgtagctcactgagaaaccttaaaataattattttgaattctttatcaggagattcttaggtctccatttttgggggattatttagttgaaaattatgtgttccataggtgtcatgtttttttgatttaaaaaatttttattttagccttgcaatgatatctgtacatttgaaagaacattcacctcttccagactttatacactggtgtcattatggaaagacctttacctacacatgggtgttagagtgccagctggatgggttatggcagcaaatgggggcacaacggtagctctggctgtagagacagtgctgagtcattgtctctgtggagctccatcagctgaggtcagcattggtaagaactgtaggggtccttggtggccaagtctgcaggtgtccatggtggtggtgagagctcctggggtcctcagtggcaaagactgctgtggtcctcctgatttctttgttccccagggtgggatgtcatggccaagtagatttcccaaggtgctgggtctggcttatgggtacattcactgagttagtaacatttctgtccaaggtgtgggtgtacatagagtgggcatagagctggggtctgggacatgcatgtagttttggggaagaggttggtagctctgtctttagagagtggggatggattaccgtggtggctctgactctgatgggagggcaatgtacagcagagactctgttcctgaagggggaagcagtattcagcaggcttcagccccagtggggtgcagcagcacagacaggtcatcagctaggctcagtttgtcagtgaagactggtaatccccagtggcaaaatctgtgggagtccatgacagtttcaagggttctgtggctctcctgctctacttttcatctgtggtggggggttgaggggaagacaaatcaaaggaatcccccttggtgctgagctgtgctggatggagctatgaggtggcacagataaaagtgttttgtacacttttctatgcagtcaccttcagtttttgtgctccaaagggcttcagcagtttctttaccatattccaagccatcacagagctatatttgtcattatatagttgtttattgtttttgtgggagggatggctgttgtgacttactagtattccatcttgcttatatgattcacttccctctgactttaaaactataaataaaatatgcagacaagcatgggcagagttactattcaaataaaagctttgacctaacaattgaatctggaaattttaaccatctatatgttattatagggctgcctaccaattcaggaaaacatgatgaatagtttacataaatgattgtaaagattaatgtttctttcatgtttcacttataagtagaagctaaacaatgagtatacatggacacatagaatggaataacagacactgaagactcaagaaggtaaaaatgaggggagggatgaaatacttttgagtacagtgtacataattcaggtgatgggtgcactaaaagcccagaattcaccactacataatatatccatgtatcacaacttcacttgaactcttaatcagaagaatgactaatggttttcaaactttggcatgcatcagaattatctggaaggtttgttaaaatgcaaattcccatgccctccctccggaattatttaggtttgcatttctaaaatagtctcaggtgatcctgaagctcctagttgaggaccacactttaaaaaaaaaataaaagcctttaatttttatatacaaatagatattttaaggatggaaaccagatgctcttgattgacctatctgtcaggctactattctcctttcccttttcaggttgaaacacgcttactatcctagatgtaaggccagacatggaagggaagaggaaaagaaacatttatgcctgccagactctctttttaggtagaaaaaatgaaagagcaaagaaaagagggtttaatatcagcttatctaagacctatttggagaaacttagcactttatactaaaagaaacttattgacatctgttcctcaaataattttccatcaattttatgaagacaataatacgtgattcaagtgtgtagcaaacattgagaacaaatgtactaggaattctctgtggtacaggaatattcattttcaccatcagcatcttcgactttaaagcctaagtgtgatttttgtgtttgtccctccagggctgtatcatgaaccatggtgatgatcttcatgagcaatccttcaaactgactggagttgtgtctctgcgagtctttgttattggcgttttgctatatttgtttgtctagactgctgtaataacataccataaattaggtagcttgtaaataacagaaatttatatctcacagttcagaagactaggaagtctaagatcagggcaccagcatggttgggttctgatgagggctatcttccaggttgcagactgctgacttctcgttgacttctcgtgtggtagaaaggataaacaagatctctcagcctcttttgtaaggacactaatcccattgtaagggttctgcccccatgagctagttacctctgaaaggcagcacgttttaataccatcaccttaggagttaggtttcaacctacgaattttggggcatatattcagaccatagtatgtcttaagttggaagttgatcctaattcacagtggttctggctcagatactgtcagccattctgggttagatcctacttggtgctctggattacacctcagttaagctattgccacattatagaccttcctctcccccaaatagttttgcttctgacttttggaatagtgtctggaaaatgacaccccccccatattttctaagtatgatctgtgtgaaagtcttagttgaaatgttgttattttagccaagttgattaatactgaaaggtgttactaaggctatatattaatggaacttctgacagtagctgccattgggtgagcttagattaaatagtaattgtgattgaaaaggaatgtaattaattataccatttgagtggttctggctctcattaaaaggtgtcatgattcaaggaattgtgatagacaaccctcaaagttatacagtttttattaaaccacaagcacagtggattcaactttggaatgatgttctttctcagggaccttcctgaattatcaacattttatatatatgtaatatataacaactgtgtggctagtccacacctggatttctagccattagactggctaacaagaacacttggaattctaaggtttctttatgagacattcaaaggcctttgcctaaaaccatttgtctgataaatggaaattcaaatataggaaacctaatggtcattttgacaatttagctctatttatttattcattacaaaaatggcaaaaatgcggttttaatgaagaaacttacatacattattcgttatttttattttaaaactgacctgggtataaaacagattgttgcattttctgatgtgatttttaacaagagcagagtagcagacgatttgagcataactgtagaacactgcatgattgaatgagtgaaatgccatacaattttcagtactaggtagaattctcactacccattaaattgaaaaatgagagaagcaagacttctgctgccacccactttggtaaagagtccagttttcttggtacaaaaataaaatgcctactccactctcttgagcaatatctttgaaatattactaacctccatggcagaggttgcttaatctgcaaatgttttggctagcaaaccattattattgctaataacccttactcacattatccagagaactgcttcttctaccattctttaacaaatggaatatagcatagtaggcgtactgagccgtattaaattttacacatcattagtccctacctcccttaaagttttagcttatattttttcttttctatcttccccacaaagacatttttttgtccactaaggaaacatattgagtgagatctcatgcagattagtgtaattctcttgtgtaattttgtttaaaaaatagttaaagggctatgggaaaatgtggtgactttgataaaaatattttaaaagtaaaaataatgtgttttgaccgtgtgaatgatgtcacatttactgtgtaatatgtaatttaaaacaactaccaccaaaattttttttagtttgactctcttgattcaccataattatatcacaacaaactcttttcagcaggatcagtttttaaggttgagtttattataaaaatatttacttataatcctccattcattaattgttttatggtctgatatgctttggctctgtgtccccacccaaatctcatctcaaattgtaatccccacgtgttgaaggagggacctggtggtaggtgattggatcatggcgggagtttttcccatgctgttctctgacactgagtgagttctcacaagatctgatggtttaaacgtgttttgcggtttgcccctcactctctctctctctcctgccactatgtaagatgttccttgctcctcctttgccttccgcaatgactgctaattttctcaaggccttcccagacatgcagaaccatgaattcaatgaaacctcttttcttcataaattatacagtctcaggtagttctttagagcggtgtgaaaatggactaatacatggtcatatttttaatttttggtatgcagtgatttggaaatttccaccagtttttgctgaattaggtaaaaggtattttcagagaacaacatgcaaactaaaagtaagccttctttccagctgctaaaaattggctgtttcttttataagttttcaaaggcaaaggcaacatttcaatcagcagtgagtattctgcctttcaccaaatacagtaaaaacagatctgcgaattattcataatgatctgtcatcagttcttgccaatcatggtattcatatgttagtgaacaccatttatgtctcaagccataagtaggaatttttttgaatcaagacttgaactaggacttgagatatgtgttgtgaagtcaagcagaaccagctcgatttctcagcaggacgggacaataaaatctgtaagtgtgcaggcgaggtgacataggataaacaaattggatgtctgattgaattatgtctattaaaatcaacatttggttggttaaataatagtataagtttttatggaaatttacaatgaatcattccttaatgtagcatttataaagccgttagctggcctaaaatataaagagctaggaagttatcactgccatacttgcagcaagaaaggccctgaacaaactgaaaatcaacagctattggtaaattagtcagagcattgaagtcaaagggaaaactcctcccctcaaaactagggagccaggaaaagggaaaattataccttattgggcacagaagcaattgctagatcctaaagaggaaccaactaattgttagggattgaacacagactagcttgagagaaaaaaactttcggggatcccggctaatgagggctacacatttttctgagttttaccttcaggaactccaccgggttctcagggagataaaattggagaagaatcctttccgtgcttcaagcaaggggaaggataatttaacaatttcaaaataagctcagagcactctcttctcattggcaaaagatctgtactccagggaaataattttaccagactccaaccatcttgagttttatcaaaatctaattgatctggaagaaggaaaatacctaactctagctttctttaggcttcctgtctcacctaatggggtaggaaaaggaaaggaaaacactgagaagcacttgtgaaggttaaagctgaggaacacaggcttaaaaaagaccgaaaccttatcatagaaatatagaaagcttcccacctatcaccacatgaacaagactcccgttaaaaataacgggattacagttgaaagaactgccagcctcagaccttatttataagtaaatttctgggtaaacctaaagacaaccaggggaggcgaaaacaaggacactagatggaaattctgaaaatgaaaaggaaatactagacatcaaagacactttaacagaaatgaaggatgtcttgaatgtgctcatcagtggaaagaattagtgagcttaaagaatctgtgaacttaaaaatatgttaaaagaaagctgaaaagcaaagagaaaaaggagtcaaaaaaggaaaagaagtgtaaatggctcttgagctagaaaaataatgatgtctatcgtgtgtataatggtttatgcatgtgtgcacatgcttgagttaactttctaaagaaaaccggtattcatgcagtttcggaacttgcttcatttatccaatgtgcttctttttcagaaaaatttgatatgtgattacatattacattattttattaaagtctgccattcccccacctctagctttttgtgcttccagggtttctcaatcagctctcccaacatttctcccaataacatctggggcaactgagcagctttcacgaatcctcacactcatcacatcccataaaaagggaccttattgataataaggttctcccactttagaaaaaaagtaatggtttgcaaagcaaatgtacttgttattttttactttacatgtgggagacattgtaatctagtaaaggaatgtctctgtgtaaggtttgtagacagaaattatgaatcttgaatgaaatgccaaatactaatgcgcaactcctgggacattctgctttccatagttagtttcagtgaatgatgaatttagaaaagattttctagaaatgagtgaaaatgacaaaatagcaggcacattgcagatgcttcgcattaatggtgaggaaaaaaattgaaaaatgttgaaagatgtagaatattctaactgcaataatatttgtaagatattttctttaggtttctcatttttcacaattgatacttttgtggaaagttatggtgcatttttgggaggatattgattgttttatggtccgatatggtttggttctgtgtccccacccagatttcatctcaaattgtaatccctacgtgttgagggagggatctggtcgtaggtgattggatcatgggggctgttttccccatgctgtaaaatttaaatttcattgggatgtggactaattgagataaacacttaaatttcactaggatgtggactaattgagataaatcttcgataaatattatcaatggaaaatctgtttaaaaatgaattaacttttcctgacttggtattttatggccagatttccattgattacttagtaaatagaatatttgtttaaaaaggtggtttttgtttcctgttctcctattttgaagaggataaagggtgtctcacttggtagaaataatattcacccattcctttctctttttgtctgacaatctgattaagaaggtacctaaaaaaggaaccaggaagaaagtgtggaggtcactttttaaggatggagaaagagaaaggaaatattaggataagtgaagtaacaatgtttccatgatgaatgttttgggaggaaaaagatggaaaaaataacgaagctttctttcaaaggaaaaaacctcagattttcaggtcattttttgtctctgccttaattatatgttaacagcatttgattcttatttcacaagaataagcttgcatatgggaaaagaagggaggcatcaggttacgagagtgtcccacagttctctttctgctatttttgctattactactcctgccttgttctgccttataaaccttgcccttcactagtgaggaatacaagcacagttcagaagagactgtctatcatagccctgaaaataatcacctttcctgagatagtaaaattttattttagaatagtggaatacagtgctaaattgatcactgtgtactgcttccttgtttcttttgttatctatattttaaaacattttaggtcaaaatttcctattttcaaactgtgtttctgtgacaacagaaaatctaaaaataaagcttaattttagatttttttaaacctataagccttaaaataccttgcaacttacttttcatttccctcatagattttcttcagggaaaataactttcatataaagttacagccataggcttgctattcattaaacctaactgcttgatctcatgattaacttaagagaaaccttaacactgagcttttgcttttaattatttctgtgctgagttattgaaatacaattccaaattatatttatttatatacatacacatgtgtgcatatataggctacatattttatgttaatattttatatattgtatctagggcataaagagtaactccgtgttttattagtatttcattattttgcctagaaattataaacctttatatctctctgatatgcatttacacctctgtcaatttgagtgttttataaaattgccaatattttaaaatttgtgagcctcttctatgtctctttcatacttttttctgagttttttatattaattggatgttaaagagtatgcactgtgctaaaatatgtcactgaaggttttttctttggggtaactgactctgggcataattcctcatggcatattaaaaatacagagaagcaacattgaagtagttttgaaatctactgtagcctcctaaaaagatggaggatattacagttgtgtttcccttttgtctttctttttctaatatgaacacttatatttattttttggctcttaaatctaaagactctttcttacttgggttttgtaatagtatttatctcaatgtagatcattatcctgtgggcaaaattgtcattatactgagagccttagttaggaaagaaatgctcctgggaatttctgttttacattttagaaatctgaagttggtgatagcgtatttcaagagaaatagtattctttgtaatctgtatgaaatttcttttcttgcccatctataccccctctgttgccttaagccatttttttaggaagaggatgagaatgaagaggtctcaagtacctaacttagccatagttgtgggtagatcccactcattgaaaatacactgcctcgaggatgctgtcagtctgctgatgactatggcgaagcaatggggctacagctttctccactctggattttactttaagctcctgttcctaaagtgaatacacagaatattaagggaaacttaagaaattcatcgtaggcttcaggtagttgtcctaaatctatatatacaagatttgcatagatgtaggcaagatagcttagctacctgactgcttcttgtcacatcaggattgatgacttggagtaggtcttggatgtggaataggtgggtgtcgcacatgaatatcttatgcttcattctctccattctctgcctctttccttcagtcctttctctttaatctctttcctcactaaccatccacacaaatacacatgatttcccagcccctctgttgctaatcatcccatgtctttccaattttgtagctgaaagcatctgctaaaagcactcaaattttttttcattgacttgatggttttccactggtttcgcagagagatgaagggatatgccagagtttttctatcttctggatgtgttaggggaatataatgacaattgtgtttcccatttagagaaaataactagttgatagggttgggtaggtgcttttactctagacaatagcttattttcacccaaagtattctgaaagcaaacacccttcccactgtgatgattcatttatttctaaaggtccccatctggcctctgtgagaaattcatattctttctattaacataactttgaccttatttgtaacaaataaataactaataactctggctttattgtaacacaagggtatccgcctttccctgccctgggctatgttaaaaattgtcttttattaacaggcaatgaaagatgctatgcctatttgcttctctatgattcctagatttctgtctgaacaataggagcgatgggaaagaaattcaattcacgaaatcacttcttacacaataatttgtccaggagtgtcctgaaattagtaagttagaagacatatagcctgtaagagagcctagctttcctcattcctattctaatcagtataggttttatattctctgtcaaataggaatgtttccaatatctttatgaaacattcattttatttttttcaaactctcaaggtaaatcagaactaaaattatagatgctattatttatgaaggaaggacatatacaggataatgtgcaaaatttagctcagaacatctatgctgtgtattctttgagaataacgaaggttgtctttgtagtcattaatttctcaatcttttggggaccatttctggttaatgctgaaaaagaataatataaaagcactcatggctgctgtctggaaagaatgaatgttttcgcaaatggatatggttttgtattttttagaaatagccgccaaatgctacatctttttatagttttataaaagggaactttacatactcaactcttattaagaaaaaaggtgctcaggctgtttaggctacttgcaatattttgggaaattatatgtatcagaaccttaattgctcaatgctcttatacttttcctttcgcctgtattctggtccttgcttcttcctctgatttacctgaagcttgctattttagccatgaatcatccaccaatctgtattatccacacttgcaacatttaggaacaatcactccttcctcatagctacgatctgtatatctccctttcctttcatctttctctatatttcttgctgctttttttcttttcctctttgtctgttgcatgggaactatcattgccaaatatacttctctttactaactgctgtttctcttctaatattatctgatataactatatctgcatcatcttgttatatgattttgttgtctttccaggggtcttagagtggggaggagagtgataataatattgcatggaggtaatagcaattgcgtcttatccctctactgtttcaaatgaagtcccattaaccattttatgagtttattgatcacctacagtgtcacatgctagccactgtactagaagaggtcctaggatacaaagatagacaaattctacttcctgatgtaaaaaaccttataaactaagctctagagaaatgtcagatccatgtaattgcttagtttgtgatggcagataattgatagccttgaatctcttatagtgacaaattatagttctttatatccatttgtgagctgttggtgacatttgaatcatatgtgccaaccactcatttgacattgttagagtaaaagtagtctgaaaagttaatgtttctaaatagttaagaaattttggagttcttcacttattttaaagattttttttaatggaaatcatcttataatatacatctcccttctgagatgtgaataatttagcctaagatttggtctagtatctgggaaataaaagggaatgggattataatgataaaaaattataaaatagcaatacaaaatggtgaccaaagttattattcatttttatatgaaatatagagtgaaaaatgtttgcatttttcaatttgtttttatttgggaaatgcaattaatagtatttttttccattgccagaaaaaaacttggttgacattgattaattgcctcctatgtgacagttactccacctcctatgtgtgttaacttatatcccatctcagctgagctattgctttgaagtcaaatactagctagttctaatatatgccatatgatgttatttaaaatattggaaatagctaacagcaattaaaatttgtcatttttatctatgtgtttgtgcatagttaatcttttctttgtgattaatttatgcatatatcttaaaagtaaagtttctgtggtggttaatactgagtgtcaacttgattgtgttgaaagaggcaaagtattgttcctgggtgtgtctgtgagggtgttgccaacagacattaacatttgagtcagtgggctgggagaggcagacccaccctcaatctgggtgggtaccatctaatcatttaccagcatggctagaataaagcaggcaggagaagatggaacagcaagcttgctgagtcttccggccttcatctttctcctgtgctagatgctccctgcccttgaacattggactccaagttcttcagcttctggacacttggacttacaccagtggttttccaggggctcttgggccttcagccacagactgaaggctgcactgtcagcttccctacttttgaggttttgggacttggactggcttccttgttcctcagcttgcaggcagcctattgtgagacttcaccttgtgatcctatgagtcaacactgcttaataaactccactttgtatatacatttatcctattagttctgtctctctagagaaccctgactaatacagtttcctttaggaataactgattcagagaagtatctcctcaagttttctttctctttcagatgctgcaatgtataatatccctttctattccttttctactttagcaaaaccttgtttcccaaactctgtttcccattttcactcttttccaatgtgagtgccaggtgaagtatgtagtctaggcctacaaatcataagaattcacaaagaggaggagagcacgtctatttcctgattggttattttcctcagaccctgtccctctgccattgcttctctataccttaaagtccttgttctcctctcagtctgcttgagagcctgctgagaggaggggttccaaaataaagtttaaattcatttcaatcctatatgtaatcaaatatccttcatgattcattgtatgtgtgaatatattttccttttaattgcaaataaggtagaaagtgaatggaatggcatttctgttggcagtaaccaatcttagaaaacatcaggaagatattttaatttagggaaaagatcgtagggaaaaaaaatctgtaaaaatatgtttacttctatagtggaccaagaaagataccctgagtaaaaactagtccagttcctacaccagagaatataaagctgatatggtttggctgtgtccccacctaaatctcatcttgaattgtaactcctataattcccccttattgtgggagggacctgatgggaggtaattgaatcatgggggcaagcctttcctgtgctgctctcataatagtgaataagtctcacaagatctgatggtttcataagggggagtttccctgcacaagctctctctctttgcctgctaccatccacgtaagacatgacttgcttctccttgccttctgccatgattgtgaggcctcctcagccatgtggaactgtgagtccattaaacctctatcctgtataaattactcagtcttgggtaggtctttattagcagcatgaaaatagatgaatacgaaagtagataatccagttcctgtgacatccagaagaggataataaagaaccagtaaactaagatgcgctttacataccttatttaaaaattattatttccccctaagttcttgaaaagacctaacttatcctttactccattcacttcctcttgctgttgccataccggatcccttgcctctaaccttgaattcaccaatgtgaaataggcacggtcttactttcaggggcccaagaaatggttatgttatttcctacttcagaagtatggtacttcagaagacaactggctgggttgtggtgtttgaaagtaattatcaggttctccttccaaaatatatgtcatgctatttaatatgatgcttgtgtgttcaccattagaaaattactatttcttaaaggctttggaggtttcaagcaaatcttattaaaagggagattttcctagggaagtaattgcttaaccattttttaaaattagtacatatgagtgatgataacataccaaggaacagaatcccaaataatatatcataagacatgtcactggagaagaaggtgatgtcagccccctgccagcatagctttctttactaattctagttaaatacattaggtagtcattttatataatttttattaactttattaagctaaatatataaactgtgtcctgattactaatactgatacctatttaataattcaatataaagaaatattttaaaaataataatagacacaacttaagtaattctctgagaattttagtcattaccactagtgtatacaactcattttccttaataagttaaccctattctgtttctaatgtgatctgttttccacctttcctatgtatctatctatcagtcaatcatgaaagaggttttaactactcatgcacttaatatttattgaacacttatcatgttctacgtaatgtgttaagggtatagtattaaataatacacatctagtagctatcttccatacccaggaagttttacaggttttttttgttacttgctaataataacaactttatcctgataatattgctcagctgctagataaaatttctgtaatgacttcaattaaaaagcctctatttttattataagagaaagacatattagttaataataacttaaccctaaaagtatatatattgtaaagtaaaggtctctccccactaaatattatcccccataatagtgctgctatgaatttagtttatacccttccagatagcttataaaaatatagtagctacattttacataaatgagatcatactggctcacactgaactttgtggtctgtattttttactcaaaattatattgaatactttaaacatttcaatatgcttttatcctgtgaattacagccttttcattttcactgactgtatagcattccactgcctggatcgatcatatcgtggtagatgtatttggggctttttctcgcttttcaatttcttaaacagtggtgaaatataacactgaattgtattgagcccctaaatccttgctaatatttgtcattctctgattatgaataaagtagagcaatttttctcataagtcagatctgtcatccaatatgtggcccagcacttgattggtctgctggatttctgttgtaaacctacgtcattgctacccctttctacattccctctgtattctttcaggtcagtctcagcaataaattttccaggatctctctcctaatggttctaagttatattcaactaatgagaggcatttaagggatattagctattagaactgaaatcagaatttaaaattaagtggctttggattgacttattttgctgaaattaatctattaatacaaatcaatttgatgacccaactgattgtgtttgaagtcctgattcagtttggatttgtgggctaccatttaatatttgtagcaattctgctgagctcaatccatatggaagtttttcaaatgacaattttcaaatagctgccataaaaactaccacaggaagcaaattttaaattcctcagtaatttctgtaccttttagatagtagtttctatactttctcctttaagcttcttttttccactgttaagtttgtgtttatcagttgatgttagtgactgagcatgaaacctagctgcaagttgcattttcatctcaatttcatctgtgaagtgtagtaaacttggccactatggtttaatctagtcagtaaaccctggtaagataagagttggtttaaaccaagccagaaggtaaaattctcaaacaagtaaaataattttatctaaaatgatactatgtatttgaaccagccaaacataaatcctagaaatctgttggactaaaataactagaccacgctagagtcttgatcttggtcttcccagactctagaactatgagaaataaaaacacaaattacccagtctcagttattttgttatagcagtacaaaaagcatatagagacatttatttttctgagtccaactttggaaatttctgatcaattttgatatattattcttactattgacacttctctacatattaaataatttagtctctctttttttttttttttgagatggagtctcgctctgtcgcccaggctggagtacagtggtgtgatcttggctcactgcaagctccgcctcccaggttgataccattctcctgcctcagcctcctgattaactgggactacaggcacccgccaccaagcccggctaattttttgtatttttagtagagatggggtttcaccatgttagccaggatgatctcgatctcctgaccttaggatctgctctcctcggcctcccaaagtgttgggattacagcataagccacctcccccagctaacttagtctctctctctctcttttttttttttttttgagacggagtctcgctctgtccccaggctggagtgcagtggcgtgatctcgactcactacaagctctgcctcgtgggttcaagcgattctcctgactctatctcccaagtagcatgcaccaccatgcctggctaatttttgtatttttagtagagtggggtttcaccacgttggccagtatggtcttgatctcttgaccttgtgatctgcccacctcggcctcccaaagtgctgggattacaggcatgagccactgtgcccagccaatttagtctcatttttaaatgttaaaaagtgaagaaaagctttgaaaataggaacttggataagaataattaaaggaacacgattaagggacattttaatactggcatgacacaagtcattcagtgcaagaatgacagtctcaggaggatggcccattgtcttgtgctgtcacaactgtagatatatatagtggccaaaggaatcacagtataggggttaagaatcacaattataaaaatatggaatgttattatgcagtgtgatagccacacagaatggctttagatttgatatggtttgcctgtgtccccaccctaatctcattttaaattggagctcccataatccccatgtaggagggacctggtgggaggtaattgaatcatgggggtgggtctttaccctgctgttctcctgatagtgaataagtctcatgagatcttattgttacataaaggggagttcccctgcacatgctctcttgactgctgccatgtaagacgtgactttgctcctcattctccttcagccatgattgtgaggcctccccacccatgtggaatggtgggtccattaaacctctttcttttataaattacccagtctcagatatgtctttatagcagcatgagaacagactaacgcaaggttaataagttgaaaatctgaaaaacaatatttgaataaaaatagagagtcatagtacaattctgcaaaacttagggtgtggtcaaattactgagtattgttcattttattttgttgttattttcatcttgtactacattacagtcagagaatgtatcctccacaagggctgcatattgcagggtattgaactcttccattgttccaagggtcctatgagtggtgggaaacaaatgctaactctctgtagaatacttgtttgttaatttatttgtgtgttcctgatctctctagaactataaaaaatgtatttgtcttccattggtattgtgtttttcagcttctcctggattctatcaactgtatattttaattatcttatgtattttgatgttgatatttcatgtaagggatacatgtttttatattgtcttttaatattgtgcccttcataaataacaaatacagtataattagtgcatgtaagataaataaataaatatagcttttgcataaattaaagttttctcttattgctgttttttgatccactttcttgataaatgtagtggctctattgtcaagaagactgccataatgatagaatgtatgcacatgaatgtatgctgttgaatcattttgcatatactgacatattcaataatcttagttggatgtctttgttggggtttagaacatgctaccccagaataagacaccttggcatactggatattttaagctaaaggaatctgagaaaacggcagaagcagaaagatctctctgactttcccctgcccttctcccctaaatcaggtcatgaaacttagagagggttttctgacctccctggggcagatcataggaccttcttgtgaaagatgcttttctatacctggagtaaaggaacaaccttaactctgaagatgaagagtcggaaaagaatctgaacaggcagactttgctatttccatcagcttattactattagatcacatctttttgccttatcatatttctctatgactatctactcttcatcaaacctactattaaaaaaactcaagtttacttattttatatcttcatttctttttgaagactcccatgtcacataaaacttatactaaataactgtgtatgattttctgttgttaatctatcttttgttataagggcctcagtcatgaacctagaatgggtagaagaaaatgatattttgtctctcctatgtcttcatcatttagaaacacattggcaagtgaaatatataggagtatgtgtatgtgtatatgtatatatacatataggacatataaatacatatataaatacacatataacatatagtgccattttcaatgattttcaggatatgatatatgtattgtaactagaaatcttatctctgaaggtatatgtgtatttgtgttaaaagtttttggaatcctggaggaatgtgtgttgagtgtattttttagggaaaatggatacattgtatttgagattttgtgtctgacttgttttgatcatcttgacctgccatatctataaagcactgtagatattcaattaaaatctatcttggaagtgtcaatcttttacacttcaggggtcaggaaatgtagaggtaagcaaagtgtctggattagtatagtggctctttctaaagactgctgagacaatttaaagactcatggatgataaaacagaataacgtaaatgttattcattttccaatttcagattcagtttttgtgctgtttcttctttattctggatttctcagggtagtatacacagttagttagatgttctatataagaattgaaaaagcattagttgttcttaagtcaaaagaacagtttccataaccacaagtatcttaattatgtatgtcattttttctttatagtggatgtaattaagatcaaggcttgttctaaatggtaggttattagaaatgacataacattttataagaatcacgtcattgaagactgggaggatttaggtatgttcttgattttagccaagtcacttggagtatctcagggaccttgtgttttggtgagtggagctgtaaaacatgaaaattggaattgatcattctatggattctaccaaatctctattttatgaacattatcacaatctttatactaattctataaaaacgatagcagtatttcacaaatgaaaaaattcaagctttgagatactacataacctgtgtgatctactaggaacccgcaggtgccagaatttaaatctactcctgttcgccatccgaatcctatgctcaatacactattcattactaattttataacttaactgcccataattttgggactcgccatccttagccctatttattcttatcattcccattctttaatatttgtttaaataagagaaactaatgtacagtggagtttcattgtttttgttgaaacctcaatcattaaacttactttgattatttaattttccttgcagtgattcaaaatcaaaaaaccagaagtgactagattgaaaagtgaccccatcagtcttttctcctttcaaataacaaggaaatagctttaattttttttctttagctccattgatgccacttggcgacagaggtacaaataactagatatgactgttctttgaatagcaccttttccaaaagacaaaatttaggagttaaataacttactaacatttgttttagacatttaagtgttttttattgtattggaggatagcaataacctttctttagttttgttttcattcatttctgtaattgtaaagaccacctacatgcttgaaactgataatttatgctctagcccaaaacatttttaaaagaccaggcttatacatccagttgcctaattgtcatcttcacttagatctctcatatcaaaatatatttaacattttactgtgaagtaaaatgtacacatagaaaagtgccccatcatggtaaccactatcctaatgctctaattttacagcagttattaatattatatatatgtatataactgatgttcttattagtttaatgtctacttatataagctgtatgcttcatcagtacaagattttattcattatgtatcatagtatctagcagaaagcccgactgtagatcagctgtataatattattgagtaatgaagggaaatagataaaatataaccaatttttattatgcacatgtgcaagtttgctgatatctataaaatttgatggttaattgaaggtttaaggagaaatggaaagttaatttatgtcagttattgtacccatattttcttgtggcttttctagcattattcagctaaatacaaaatattctttcttcatatgtaacagataaatagtccaaacagacttgcagtattttattttcttttgaataaagaatgggaagatgaagatcttgtagttctagtttacataacaaccaggcataaatattcttactaaataatgtcaggttgacattggaaggtcattcttctggcacagttaaatttcttatcctttcttgatttgttatttctttttttcttcttcttcttcttctttttttttttttttttggcagcatcttgttctgttgcccagactggagtgcagtggcaggatctcaaatacttcttctttctctcttaacactcttctttttgcccatcttcctttcaccttctctgttttctcctactgtgtaccaagccttcagacctgttggcagcatcctgtgggtcttgcttagccactggtgaccttcggggttgatgaggaatagaacaacatatagttgattgaaaccagattggaactactggcaggtatcttgtgtgcataattactttttagagttctttttagtttttggcatttctggtgaattgtctctattgtgctaatgtattagttccttatttgaacacttatgcagctgcaagtctataacttagaaaacaaatctcatgtacatggatttttagtcttctaaatttgaagaattttcttcaaaaaacatattttatctttatgtcttccatttatttgtatagatttagggggtacaagtgcaattttgttacatgtatatattatgtagtagtaaattctgaaaacatcacccaaatagtgaacattgtaatcaataggtaatttttcaacctttattcccctcacaacttttggagtccacagtttctatttttccaatctgtatatccacgtgtacacattgtttagctcccacttacgtgtgagaacatacagtatttgactttctgtttctgagttgtttcacttagaataatggcctccagttctgcaaaagacattattttattattttctatagtggagtagtaatccatggtgtacacgtgtgtgtgtgtgtgtgtgtgtgtgtgtgtgtgtgtacataccacttttttaatccaatcatctgttgatgagcacttaggttgatttcatatttttgctattgtgaatagtgctgtgataaacatatgagtacaggtaggtatcattttggtatgatttctttcccttttgtgtatatagccagtggtgagatttctggatcaaatggtagttctagttttagttatttgagaaatctccatactgatttctataaagattgtactaattttcatttccaccaacagtgtataagcgtttcctttctctgcatcctcgccaacatctgttgtttgtggactttttagtaatagccattctgactggtataagatgatatctcattgtggttttaatttgcatttctctgatcattcgtgatgttcagcattttgtcatatgtttattggctgaaaagcatagttttaaatgggtctctgagtaaatacacaaaatattccatgatactactgttcaggcaaaatgtcactaaagcaaataaaaatataaaatgaaaaaaataaaacaaactttgccttctgttttttctgcctacacaacctctttagtaaagagtaaaatatcatatattctatatctgccatattttatatgctttctgttcagtgaataacctacaattatatgtgaaactgtgaaaggtaaaataaatttattttacatattaagtaatgcgtgaatgtaagcatgtttcaagaaaactacaaaatatattttatagcaattttaaaattttatccttagtaatctgtgtggcagagtacacacacacacacacacacactatcatttggtaataatgccatctctttatctgatatcctaatactatattactataatatcacattttatagatgtccccatgatcttaagaacactgctaagtgagggattatagatattttcatgtgtgtcaccttgatgcatacattaaaaattctaactcattggtaagattatttgaagtaccttttctgcaaccaaatctaattaaaagtaaaattcacagtatatggtagattgatataactatgcattaaaatgactgctataatataaatgtatgcatgtgtgttgatatgtgtttatatacagatgtgtagtacatgtgcatataacatggagagcttaggttttgcttatgaccattccaattaaaatgatatccatggttgttaaagcagattgtcataaacctatgaatggctttccttgacattattttggcttgatgctctcgtgatgctcccaaaagtagataaagaaggtgctatgccatacattcttttcctggcctagtaccattgccacagagacctgctggccaaagataaccttagctgtgggtactacagaaatgagaagcagcatcatgaggaatgtaggcattttcactatctccctttgtctttcttatggttttctttagtaatacagttttagtgtgaatgagagaacagttttctggactttatgtgactgctttttcaaaaacaataatttcgactttaattagaaaaaaatgacagaatgttcagaaatttttatctactgcttagaagtaaaacaaaggcaaaccctatgtagtatttattttttgtattgttttaaaatcttttatgccatgtgttaagtggtgtggggggtaaaagctattaagggaatatcccaaaagctggcagtgtaattcaggttagagaaggaaaatgttagttcttaaaaaaataccttgataagaattcggttagttagtgtttctaaagctagactttcattttaaaaagctcattgtatgactctcataaaaacataggatgaacatatgccaagaatttattcaactaattaatgagggagctggcagaatgatcaagctggtgctaaggagaattataggcagaaagctatacaggcactagagaaagattgttggggaatgatggctaggttaggtatgtgactgcttaatgccttccagggcaatggcctgtaacagtttgggattgtctttgctactgaacagaaagtgcttgcatctcaatcatacaaaaagctacaagttaagttgcaacttacctccttttgattaataataattttaaaattaattataaataatcataggtgcattttttatataattaaataatcaaataatgtaacaatgctctaccgtaaaactgacaggatattctgcttttgctttgccttatttctaagttttaaatatatgtatttttcttaacagaacagtcactgatgtgtaaaaaagcactctttaaatgttttaaaacaaggagaaaatgtcttaggaggtgacaccctgggtacctgtgtttagggttaagattagagaactcctttctctacccaagaaggaagggggagtcataatagtgagagggctagaaaggaaatgagtcagggagaaagtatgagaccaagcactgcatgggggaagggtcaagagaaacctatagttgtcacatgaccagaaggaattttgagaaaagaaatgtctaagttttttaaaaatgtatttaactttattttctccaaataaagattcaaatgcttagcatgtttctcaacatggcctcagaagatttttctactctaaatctggtttcccttcactttaatgattaaataaatgttgaccaataaaagattaaatataaagaaactttaaaagttaataattaaaacacaacccaataggaagaaagacaaaagacatgaagacggattgccaagaggaagaaataagatttcccataataaaacatgttcaacttactaatcataaaaaatttacaaaatgaaaccacaatgaggtaacattttatactccccagcttggcaaaaatgcatctctgacaatctcaaacattggtaaagatctagagccctggaaattctagtatactggtggggagcataaattagtacttgggaaagcaatttggccatatctattaaagctgatgatgtgcttttgttgtacaaaccagcaattctgttcaaggtatacatccattctctggtatgtaccaccagaagtcacataaaagaatgttcacagcaacattgcatttttctatttcaaacaaagatgcaactcaataagcgccagctggagaagagaacatttgtgatatactcataatagaataatatttagtagtgaaaaaactcctacggcaatgaatgtaaaaaaaggtgacagaagaatacattcagtttaattccatttattattctttaaggatacatacatggagataaagtgatgaaggacaagaaggctatgatcaacacaaagtttagtaaaggggttccatctgtcaaacagggataaagacaggttcaggaaagagcacatggtacctcaaaggaaagacaataaggtgggtggtaggcacacaggggtttgtttattattattattattactctttatactttatatagatatatactttagcatctatattatatgtgtatatatctatattccattgcatgtatgaaatttttgaaaaattcaaacagcttacaagaaaaaattacatataatgtaataacaaaaaacattacgtataatgttccaaatggtgaatcacagcctggaggctattaatttacctccagtctatcattgacccctggctaaaactgctgctttgtttctgttcccctcacacttgagagtaagatattgtcctgctctgacaatacttaccacattttaggggcttgatccatgctgacagaaaggataaacaaactaacctgacttgtatttctagaagaactaggaaaactgaagatttgagtcacaagtacgcagtagtcatttggcttttctgatttcatggtttcacacatttttgcaaacctacagcctgttccctctgatcccttcctccaccctcctgtcctggtgcttaaggcttgaaatcgttcagtgatgagatcaaccttggaaaatgccttcagaaatgttgttttcttctgctttctgacgtggctgcttcaaaggtaataggggtcgaagccactctgcccttgttttctgcatccaatttggggaacatagccaccagcctgtcgcttcactgtactcaggagaccacacagtcatccatttgaatcacctcacccaacccaggggctgagtgatttaactccatccttgatacttatcactgtctgagatgaatctgtggtgacctcccaacactttcatgcaggacctcatgcctggctcctggaatgatcacacgatctgtttgtatttttacaatttaatgtgccactttcatgcatgaggttcacagatgaaagtaaaatcacagcctcccaactaaacagaactaaaattcagagaggtgtgaaaaatggtagggaacaaacactccatttttggaatatgtgtcttctagaatttattctcctttataattaatataaaatctgagatttcaccaatgccttaagagacaaacatacaaattgaaatctgaaaacaataattacatggaacaaagtggagcctgacacttaacaaaagctgttaaatgaaaagtatctctagaaaaagcaaaactctacagtaaaatcaaacaaaacagaaaggagctttggtacttttcaataataggagacaaaaataagtttagtgtattattaaattcatgtaatataaaaacatctatgtggaagtgttgaattaaattgataaaacagaaccaaatctaaaatagagtttgaaggcaaagaagatcttgctttcctcttctttgattgtaataaaacaccagaatttggaacaacaagtattttcccaactaaatttccttctggtctgtatacacccagcaggatggcactctgtattttatctaattttaaaatggcataatttgatttttagcagcacaaatatctaagatttaagattttttggtgctgcgtagtagatgacataatccgtctctcttgccttccatcactctttagtgatggaaattccactatgcttgtgaatgctctaggtgtgctttatttttattgttaatttttaaagcagaaatgggctgaatttcataggtaacattcatgtattagtacatttatgtattcaacaacaattgttgagcccagttatgtgttaagcatgtacaagttgctggataaactatgttcagtgaaagaaagaaaacaaaaagagattttgtagagttttgttgaggtcatagagtgtggaagtcaggaaataataggtaaatatgtagttataactgtaatgaatgctgtaaaaatgaacagagtcagtgatagtgaataatcaattaagcgatctattttaatggtatggttaaggaaagccactctgagaaggaagtttttccacagagacctgaagcaaagactatccatgaagagagagaaagtgtcccactctattagtttcttagcactgccgtaacaactacaaacctgatggcttgaaacaacagaaatgcattcttccacaattctggaggttagacatcccacaggaatgtgtaagcagtgttggttatctttggaggctgtgagggagaatggggtccatgcctcaccagtagcagcctgcagtttgggcagcctgatgttccttggtttgtagatatatcactccagtctcagcctccatcttcacagtgtcttctgccctgagtatctctgtgtttcaagtctccctctacctttcacttttaagaaacctgtcatttttaggacccatcctaaatccaagatgaattattttgagattctgaattatatctgctaaacctcctttaaaaagaagggacactttgctggtcctaagggttagggcatgggcatatctaggggactgataggtggagaattcaagtcgtcacactaggcagaaggactagcatgtgcacaaatgatgatgtggtaaagagcttggtgcatgaaagaaatggaacattttgggtgataggaagaatgagtcataattcagttgatgtgataagcaatattattatattgccagctatgccaatgaataaaactatagaataagctccaagtggattttcagaagaataagaaatacttcgggcttcctaaggcctggaatgagggttgaaattctctgggaaatccatctggcattctgattactaataactgtgattaattacaatagtatcaaatgtcttgtgacattgagcttactctaagtggatatgctacaaacttacatgtaaattttctccgaagttaccactcacatttttcttatgtattctaaaagggtcatttctccacgcccttgtttctcatgtgttgtgactatattctatttctgaggccaatgcctaatagtatatttccacatcacatctatgacaaagagagtgaacctaatttatagtgcagtattccttgggttgtataaaaatttcaagtcttgtcctatgatgtctaatatgtggtactacagtgattttgtgtagtttatatatcaccactttgaaaagtctgtttaggtcatgtctctaagatatgccaatgtaattcagtttaaagtagaatacagataccctgttttggagtcttattgaatatgaaaaaaaatcctgtacaagtaaacaaattctatttgcattagttttgtctcctattaaggaattctctttaaaccctttcctcaatgagtgccactttatacaatggaagacaacatacaaaaggcagtcctgtgctactagattatagctgatggcttcattaagcacaaataaaaaagagacctacttcaacctcttgaatgttactgtcctacttccctagccaataatgtagtgctgagattactgttgtcccagtagcaaacttgcctccagctaggttcataatcattctcgggcatctctttattaatgtcagccactaacctcaatgctgaaatactagtaacactaataaacccactttaggaacttttctgatcaaatgatagttgttaaatatttctgaatagtttctatgagcacattcactgcttataatttcttctgaaagtcatttcttcaacagcagcattcctgtaggaaaaccaattaattaccagtttaagtgttgagagtttaacactgagaaagtaattggagaatggaacagaacaaagttaatttactctaacatagactgggtacccttttatttttatttttgtgccaagcaaaatgggaataaagattaaaaaattgaaattggtctttacatcaagcagttaacttttaaaaacatgatttaaaggaacgaaaaatcatgtactttcatgaggattttcctcacatgtttatttgagcaaatgtgagatacacattgaaggactttggggagacatgtaataatttttgataatttagttgggaaacggaaatgacaatttaaaaattagaagcagagaagataattcacttattcatccacaaggctcgtagataaatggaaaagtgaaaatacagcttcttataagggagaaattgggatgtacctcactgctaaaatgaaacctgacccaaaaaaggcagtttagtaaataagattgtttgttgaggtggcatttaattatgcctaagaaaatagccatgccttatgacgaatgtgaggttatgtagaatcatttactgaatactattttgtggaaatattttctaaatcatggtcatgttagatttattttttccattaaaatatcaaaagctcctcagcaatttctgtctcttaaaagaatgataagttattggtttgtagcatttttaatatttaacttgaagcttgtttgcctgttgtattttatcttgaataacaagaaaattaagtgataaaatatagttttcatcttatctctattttattactttcatttttttcccttttggataaataaatgcgtgtttgtggtgtggggacaaaatatagagcaggaaaaaagaagcagcaaaagggatactcctctcattcaataaagcccttttaaacaaataatgttatagtcatatgaaggtcaaactagtcttactttttgatctaagaaacaagcaagagcatgaagtcttttttattaatatcttttatagaaaagttcagaagattttcatttacaagtaatttcgttttaaaaatcatttaatgttaaaggtaataagcattgttatgtcataatagaccatataaaaaaccatgttgtgaaaaacaattcttatatgtttgtgaattttccttctgatccctgagtaaagttacctagtttccctttctggcataattgattattactcagtgtactcctgaaagtgaaggagaaaatttcagttccatggtatcctttctctcatctgtcccattctcattcttctagcatcacttttctcttgggatttaaaaataaattaaaactttttatacctctgacagctatcaaatgtcctgttcagcaagataataacacaggatttgccatggtttgcgtatatattatagattattctcatgcctttattttgaactgtcaaagaaaaattgcactcgaaagttaagcaggcaagtaagactttatccaagactattgtaataggggatagagattgaactcaaccactgaaataaaaggcttgggaatttttaggtgctgcttgagctagtggaaaagtactgggagagtaagtgagggaggttaatcactgggattaggccatctgtgtttgctaattgccaaatatgaagttagactcataacctctcacagaaactggagcactatttttcttgatgattgcatttcaaagggatgactcccaggtccttgaaaaagacattcccggggttataaaactggcaaaaagttgggagaagatttcatctcacaggagagaaaggttgcatgttttccaaagtaaatgatctgtgaaaaaggagattttaaagaaagaatcattactgggaataaagaataataattcataaaggaattgactataatcttaaatttgtttgcacctaataacatagctccaaaatttataaagcaaaaattgacagacctaaggagaaatagacaaatccataactatagaagacttagacatacttttatcactatttgataatcagtaagattttttagagctgtctgagctgactagtataataatgaaaatagtttacctcaaaataatgcagatatgatatcttcagaggcttaggcttaagaattacttatctgatatcttcaagtccaacacgacttttctttatagtaggattaatctggattttcagtggaagaatccattttctcaaaagatttggcttgtatttattagataatacacattttttataccaccttataccagggaatgcattcagaataacaacaaagtcagctaaccataagtttttggccatagctatcaccagcatcagcagaaatacagtcagtccttctcaaatatcttcattttggtaggactgaatatttcatatctgttccgtaattactttgactgttttggctaccttgaaacactttccctcttttttttctccatcatcccttcttatatttgttttgtttactacatgtattaggatcagtttcagctgcatataacaaaagaaagccaacagcatcctctgaatttcttctagccatgaatcaggggttggggtggggaataggaatgtaacacctgtatgtgtagtttttgttcatgataggtcatttccattagattgtaatcccactggatgaaggacctttcatctctttttacctctagatatataatacaaaatagtgcctggaacataataggcactcaattggcagtttcttaataaatgaaatagagaataaagtgagttgattctggaaacacagataaaggtcattttgagtgtttttttttttttttttaagaaatatcaaagaaaataagctattctctgtaggtagtggaattgagattcctacatgagacttgataagctttttgtcagactcgtcatatttttttgtctgttttttcagtctaaacattttttaacactaatcacatatcattttatagatggtgaaaggtttaattaataaaaaatgattactttgaaatcctttgaattgaaaaaacacttaaagctttactgtattcttaaggctagtttattaataaagacacattacttttatagaaatggctaaaaataaggcaaaaatatttaggcaagatgagagcaaaataggaagtgccacttttagaccatcagacctcatgagaactcactcactatcacaagaacagcacggaggaaacagcccccatgatccagtcacctccaaccaggtccctctcttgacatgtgaggttacaattcaaaataagatttgggtggggacacagagccaaaccatatcaatctccctcagagattctgatttaattgttttaggtgtaatctgggcatctacatttttttaaaaaaatcattaagtgattctaatgttcagccaagtctagtacttattgttttaagcctctctctggttgatgtcacttgtagctttaattagtatatgtaagtaatgaatgtgtatatgtatattctaggctttggaaactttcagtatatagttaaatgactattttagttttcagcacatttgagatcttgcaactgtccatgaacatcacacctgtactaacatgtggcatatgtgatagtcaattttatgtgtcaacttgactacaacccagtgtgctcagattaaacattatttcaaggtgtgtttataagggtgtttctggatgagatttgcatttgaatttactcagtaaattagattatcttctccaatgtgggtggtactatccaatctgttgatggcctgaatagaacaaaatggtaaaagaaggagaaattaccttatttttatttttaattttactacctgcctgcttgagctgaacctgtcttctcctgccttctaccaggatatacaccatcagctcccctgcttattaggcttcagacttgaactagaattacattgtcagatttcttgagtttccaattgcaaactgcagatcatgggacttctcagcatccaaaattgcatgagccaatttctcacaaaatgtgtgtgtttatctatagatatagatatttgttatgtttcttatttgttatgtttctctggacaaacctgaaaaatactgtatagttcactgtaaccaaaaatattagaagtgattagagatagatctagtagtctttttataacttttattttagtttcaggggtgcaggtgcaggtttgttatataagtaaattgtgtgtcatgggggtttagtgtacagattatttcatcacccaggtaataagcacagtagcacagtgcctgataggtagttttttgaatctcaccctcctcccattctccaccctcaaataagccccagtatctgttgttcttttcttcgtgtccacttgtactcaaagcttccacttataagtgagaacatgcgatatttggttttgtgttcctatgttagtgcacttaggataatggcctccagcttcatccatattgctgaaaaaggacatgatctcattctttttatggctgtctagtattccatggcatgtgtgtaccactttttgtttaaccagtctaccattgataggcatttatgttgattccatgtctttactattatgaataatgctgtgatgaacatacatgtacatgtgtctttatgatataataatttatttcctttgggtatatacccaataatggaatcactgggtcaaatggtagttctgttttaagttctttgagaaatctccaaactgctttccacaatggctgaactaattcacattcctactcaccagtgaataagtgtttccttttctccacaacgttgccagcatctcttatttttgaatttttatgatagccattctaactggtatgagatggtatctcattgtggttttgatttgcatttctctaatgatgagttatgttgaggattttttcatatgcatgttggtcacatgtttatcttcttttgaaaagaagtctgttcatgtcctttgcccactttttaatggggctatttgttttttttcttgttaatttgtttaagttcctcatagattctggatattagaccttggtcaaatgcataattagaaatattttctctcattctgtaggttgtctgtttattctgttcatagatttttttgctatgcagaacctctttagctgtttattctgttcatagtttcttttgatgtgcagaatctttttagtttaattagatcccatttgtcccctgagcctaaccttggttggtgtttggagttctgcaatatagaatgcagcttcaaaaattgttgacttatgggaaagaaagaagtagtccaagagaaaaggagaactctcagaaaggaaaagaccaacagaaggtttcaagagagcaaattacagagagggcaacacttaagcttattttttctactaaaagtttggctccttactctctcaatctctttgtttcctgtgatatcattacatgagagcttggcaccatagaaacaaaatgaagctgctgtaaacctttcctggagtttacatttcaccccagaaagtgtttctgataaggttaagatgaggaaaaaatgagttactaagtgtgaatgagtctatctggtatagcacttgacagaaattaggggcttgtcaatgtgaatttgcctttcttgaaaaaatacctatagacagctcctctctgctaatcttttggccagtaaattctaaaattcagtaattaaatgtcttccaatacatacataagagaactatagtttcctctttccccactccattctcaccaaattcttataaaacatgctttagattgtcttataggatttcaaggtaatgagaaagaattttcagaaatacacattagatcatttttttcctctgctgtcaattcaagttcattaaagtttaatgcagttcaattatagtattacacttacaacattgtttttcccaagcctgattccttaggcccttgaggatgccagctcactaactgaatgtgctttttcttccctaaagagcacaaaacaaaaccctctatagtatactattatgatgatctagaataattctcatttcctctggggaaaaaaatacccattctcaaacattaaattctcctcttggggcatcatactaaaatctttgacatttctaaattatgggaaaagggtattttagtgaatataatatgtttttgtgattctgctaatttaatattttctaaaaagttagggagggaaatttcaaaacaaatagctaatctaccttaaaatatctaagacctaacagtaagttataattggttagcatttgtttccacactgttgataaaaatagcactgtgtgtctgtgtgtataaaaccaaataattaaaataaaatttgtcctaagaaaagaataaatccattgtatttaaaagtaaaaaagttgttagtttgattttacttaatttggagttaagctgtcatattgaacattgtgtaatgttggttgcagaagaattctgcaatcaagctgaaattatctgtaattccttatgatcatttgaaacagcattataaggatcctcaaagagtaaattaacctataccacccactcgaggtattagcattgttaatcatcacagaagctatgacaattccatcaacagaattatctatttgattgccagattaactgattaaaatatagtaaaaaagtgggttgtctgttatctttgtaaaccactctctgttgttaggtcataaaaggccctagagatggtgagaataagccatactgagggaaaaatgcaatcacctaattgtacagaaaggtgatatgacttgcccaaggtcgtgtaataagttagtaacaaagctagaaatggaatctatgcctccttactgtaatcagggatggtgctgtatgtaataaaggtccctttaaattactatagagaggaaagaaagaagttaggaagatgtaacttttattctttacttttctgcaattctgataaataaaccataagtactgcttcataaatgaatttgagacagtgtttttgctactatgtttttcaaaacattgtagacaaagggaattttgtcctatttaaaaagacccaagtcacagaattcttaatttagaaatttcaaggtattaattaacatatgtatatatatgtgtgtgtgtgtgtgtgtgtgtgtgtgtgtgtgtgtgtgtgtgtgtataacaactttttgtatataggttctgccaggtaaactgcaggaattgagtatgtcagattttggtatacgtggagatcctacaaccaatccctacatacaccaagggatgactatagttacgtgtggataaactccccttaataaaatgtcttatgttactaaattttgaagaattatgaagatagctatttttatatattccttttgtcatctaaatactccaaaattatttttagtttaaggcatccatttgctaaaggctaaaataagaattttgttcattgatttcctttaactaaaaaataaaaaataaactttgtttcttttctttaggcaatgttttatttaaattataagagaaatgtgattaagtggttttattatttaataattgtaaaatggagttcaaatgtatttaaagtagtatagaggccgggcgcggtggctcacgcctgtaatcccagcactttgggaggccgaggcgggcagatcacgaggtcaggagatcgagaccatcccggctaaaacggtgaaaccccgtctctactaaaaatacaaaaaaaaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagtagtatagaatcattattctatagacaatctcagtaatgagaaaccgtaaatattcttccttgaaaatatacaggcatgcctcagaccactgcataaagcaaatattgcaataaagtgagtcacacaaatttattggtttcccatatttacactacactatagtttattaagtatgttgtagcactatgtcctaaaaatgtacataccttaatttaaaaatattgctaaaaatgctaatattcatttgcacctccagtaaatagtaatcttttttgctggtggagagtcttgacttaaggttgatagctgctgacgagggtggtggttgctgaaggttggcgcagctgtagcaatttcttaaaataagacaacaaagtttgctgcatcagtggattcttcctttcactaaaggtttctctgtagcatgagatgctatttcatagcatttgcctcacagtagagtttctttcaaaattggagtcaatcctctccaaccctgctcttgctttatcgacagtttatgtaatattttgtaaattattaatggtcatttcaacaatatgctcagcatctttactaggagtagactgcatctcaagaatccacattctttgcttatccataagaagcagctccttatccatataaattttattgtgagattgcagcaattcagtcacatcttctggccccacttctaattctagttcttttgctatttctaccacatctgcagttataatagtaacatcaaagatcactgatcacagattaccataacagatataaaataataaataagtttgaaatattgcagccaggcacggtggctcacgcctgtaatcccagcactttgggaggccgaggcaggcagatcacctgaggtcaggagttcaagaccagcctggccaacatggtgaaaccccatctctactaaaaatacagaacattagctgggtgcggtggcgggtgcctgtaatcccagctactggggaggctgaggcaggagaatcacttgaacctgtgaggtggaggttgcagtgagccaagatcacaccattgcactccggcctgggcaacaagagcgaagctccgtctcagaaaaaaaaaaaaaaagaatattgcaagatatttgcaattatccacactacaaaattggaaagagtcacaaagtgagcacacactactggagaacagtgctgacagtctcgcttgatgcagggttgttgcaaaccttcaaattgtgaaaaatacagtatctgcaaagtgcagtaaagcaaagtgtaatcaaacgagctatgcctctactcattaaaaatttcattcatgccattctagtcagagtttcgtttcagtttgtttttctagccctgtcttacctaaacacgaagcttattttgataatttaatggcttaattatgaccttgctggcaatatctgtgttgccatgtttttcaaattctatcaactaaattgaaacatatgccccatatagtttaatcttctcatgtatttctctgtattaatgtttcttggatttttaacatttgggtatgaagcatttaataaggtctagaggagagactctaatcctgggaatacattattttcttttttatgactcttgattaggaggaggcacatattaaagacaggccctgacctcagctgtcctctgccatcctcctttcctctgccatgctctcccacacagcatttttcttctaaattaaattgttcattgacactattacaatctttaaatcctttatggttttattccacaacatttgtaatatgaattccccattgtcagcaaaattaggacagctaaaacctagatattttgaaactatgtaagcattcttctgaaacaaaggctgactttaatgcaatttatatttatacagtggaaagagattcatgagagagtcataagccagatttgcccatatgcttctctcatttctcggtgtatgactgagttttggacagaataaaacatttctaatatcttgggaatggtaaatatgatttcaggtataatgtatagttaaggcttttttcaaatatgtcgatattttcacattttagtttatgatagttgaaaataacttaatttagtaattgtagtgcctgaaggcatctttctgcaacaaacacttaggaaaataaataaaataaagctgaaataggcaaaagagaggaaatgagtgttttatggatatgtcataattttaatactattgagtacagtaaaacttaaacagatgctagaaacagtattactgttgattgtttttgttttattgttgtcatttgttttttaagagttctagggagcaaggaattaatttatttagtgcttactctgtatctagcaaaggaccttttctggttatctctttccctgattttaagtagacaaactctctatgggctgtgtctccatacagagagttaattattaacatatactgcttttagagttgtccagacgttatttaattatgagatgtttctttatccaaaatagtaactattctattaatttattgtgatccatatgttcctaactgaatacattctgcttattttctaaatcttacatttgttccatgtcaagaatatacaatgaagtgttgaagcaagaaacttgttaatatctttttacgaatgttggtagaaagtttggctcaagtgaaaggtaaaaaattgtactgtttctcactgatcataattcacggtagctaaattagtagaaatatttttaaattatcatataagatactctattagagcatgtttgagtcattttattctttcatactaatggaaagatagcttattttttattttagtatttgctaatgcaaagagtgtgaatggttcagttagggaaaatgtcaaagccatagaaaatttagatgaaaaagcaatggcaaagttacatattaaattccattttagaaagttatttttactggcagtttatatctaacactttaaaccttagttagagttggctatatacattataatggaaatgattttgtcccaaactaaaacagggtaaaagaaagaaagaaaggaaaaagcaaactttccttgctttctttttttattgttataaagtttttttcttttacttcagtgttttctgcgtttcatctcaaaacaaattattggtattaatttggaacatcagagaaggcatgttagaaaaatttgcaaatgtttttcattttgattactaaaaatttcaactcatgtttttaagaagagagctctacaaactacattcatgatgggaaaattgtatgtgattctgaactagctataattataaatctgggtgcaggactagaattctgtttgttaaataagaaattaattatctgtttttacaattttcatatcaaagaaatttttttccctgacatttatcatgggccaagaaatacccacaattcccaaaatgtgaattcatttagagaattcaaaaaaaaaataggcatatttacatgggagagtattccatttataaacttacatacaaagaatgatattgtacctttttcttttggatcttccaaggaaaacatcaagccagaaatcataacaagaatgattatatgtttattagttgtaagatcaacttttctttatatgtgtaagaagaaaatgcacatgatggtacaaaatgatctttgagttagaaatttacttgtgctacaacctaaattcatattctgtgatatacaattgtctcattgaagtgtcatcccaataggaattctcgtctgcattatgccagtgacaggaaaaggtaaattgagaattacgttgcattaaaattgaaaactggaatatctgaaaaagtatgtagaaactttgtaacatttcttgaaattttgttgctgagatgtttctagtttatgtacttgatatccactgttcccacattcaatgctttaccactgggtgacaaaagcatgtacagtcatatgctgcatgatggtgttctggttaatgatggactgcatatacaatagcagtctcattataatgaagctggaaaaattcctattggctagtgatatcttagccattgtaatgtcatagcatgatgtatcactcatgtgtttgtgatgattccggtgtaaacaaacctactgcactgccactcatataaaagtatagcacatacagttatgtacagtatataatacttgataataaatgactatattaccagtatatgtatttactatcctatactttttattgttattttagattgtactccttctacttattacaaaaaaaaaccaaaaaacaactaactgtaaaacagccacaggcaggtcctttaggaggtattccagaagacattgttatcataggaaatgacagctccatttgtgttattgcccctgaagaccttccagtgggacagagtgtggaggtggaaggcagtgataatgatgctcctggccctctgcaggcctatgcttatgtatatctgtgtgtcttggtctttcacaaaataagtttaaaaaatttaaaaaaattaaaatagaaaaaagattatagaataaagatataaagacattatttttgtgcagctatacaatgtatgtgtgttttaagctgtattataaatatggaaaggttaaaaaattaagtttataaagtaaaaagttatagtaagctaagattaatttttactgaagaaataaaactatttttatacatttagtgtagcctaagtgtagagtgtttataaattctacacagtgtacagtaatgtcctaggccttcagtcactcaccactcactgactcacctagagcaacttccagtccaataagctccatggtacgtgccctatacaggtgtaccattttttatcttttacactgtacttttaccttaccttttctatgtttagacatgtttagaattgcctattcaatagagtaacatgctgtgcaggttagtagcctagaagcaataggctataccatatagcctaggtgtgtagtaagctgtcccatctaggtttgtgtaaaaacactctatgatgttcacacagtgacaaaatggcctaaggaaatatttctcaggtcatattcctgttattaagtggcataagactatactgaaaaagtgaataagccttgtgaagaattctatatattaatacatttgtattcattgatattttatttttctttaatatagaagcactcacagctttttggttcacagtattctacaaaggacaaaaatgatgtaaaaagaagaaaatagataatatgtcctcttctgtgtcatttcttaaaatattcagttctgcaattctcttttgccccagaatgcctttttttctttactatatagaaatgttgaaattctaacagaaacaacatatgtcatatgatatactcagtctcaaaaaaaagcaagcaataattaggctggcataacttttgaagaagtaaaataaaatgtccacaatattatagtgttttgcactcaaatgcaatatttgaattataaaagcctggggcaagcttggttgcgtgattagtacatgttaccaatgaactcagcatcatcgatttaagattcatcatagtcaggtagatttgacttttctgaactattttcatccccctcaccctccctttaaccatctcaaaaatgtaaggacctagcatctgagtagagagtcagaatacatcagcttaagtccagcagccgtgctgagaaaaacatctttcagttctcccgctatgaattagcatatttgggtgctgggaggagagcaggctctatttatcatacaaaatttaataccccattctgctgcccaacactaatgatttactttagtgttcttatgtttctaggtgaagatcatcaatagcttaaattacctggcagactaataagaaaacaagatctctgtcttcagaaatataacaatggcttctgaagttagggagataagtttttatcaaagagatttctgaatattttaaatgatgagtgctggatttgctatttttatgtagtgattggataagcataagattatgcattttatgtagtaattcagcatttattattaaaccctaatgtgttctcagtgttgtactacgtgttagagatatagctctttgccaagataaacccagtttctttatcatcattaacaacaaagtaaaatgtactgacagaaaatggagaacaagtggaaatattcactcctcatatattggcaaagaaaaaggtaggaaggacagaaaagccacgaaggatgattgcaaggatattgttctcagagagaaggaaatgtattattcctgcttttgaaaagataacactacctaagtttcaaagtgttcagtatggccagacactgaggagaaagggaaactgaataagaattgttaaagtgaagctagagcagaactccaaaagaatatttaagcacagaccaaaggccaatgcgattttccttgcctgtaaacattgtttccaaggacattcttcctaaatgatagtttgggagacttactcatcttttttatttctatgcagagagtagcttgttacatttctttatgatgaatgaaataactaactttattgcaatggtgcatattttctctctatgtctaaacttagtaccagtaggcatttgtaaacaatcactagaaagcagcagtaatcaggtagtgaattagatcatatgaaagatgtagttgataatcctttcctgacttctgtatcttctattgcatctgttactttgaagagattgtcttttcagatgatctcttaccattggaagtttatttcaaaatgaatgtgccatagccaactatggcaaatatggcattaagttatggtatttaaaaattaactcttggccgggcgtggtggctcatgcctgtaatcgcagcactttgggaggtcgagacatgcggatcacgaggtcaggagatcgagaccatactggctaacagggtgaaaccctgtctctactaaaaatacaaaaaaattagccaggcgtggtggtcggcgcctgtagtcccagctactgggaaggctgaggcaggagaatggcatgaacccgggaggtggaacttgcagtgagccaagatcgcaccactgcactccagcctgggcaacagagcaagactccgtctcaaaaaaataaaataaaataaaatacaatacaataaaaattaactcaatgttttttatatacatttgattttgtgtcacttgtgattgtagaataaaaacatgcaagttgttgaaatgcaataaaatgtagagacatatacaggaaaaagttaaaagtcaatttgagttgcaggacataggataatcattgtaaatatattggagatctgccttccaagtctacataaacacatacacacactcacacaaatacacactttgcatccatctgtataactgagattcatctatgaaccctggtcttgacccttcacactctttacttttccatttcctcctaccactagcaatattgaggtctcctgggctgacattcttgagatactgtctttattttccttttcctttgtctttatatatctactatattgattgcttatgtgactttttcttaacatctggaatttttcaaacattcagaataaatggagagaagggaatcatcacctatgatatacttatgtgtgcatatgtgagtattttaaagaaaacttcagacattatatgtttatactcataaatattaatacgtcaatatatgtctctacccgagggtgacttttagaaatataccctcataactatcattagtggtaaaattaataataatgtcttaatattatactctttttttccctggtcatctcaaaaatgtctatttgcagttggtttctagtcagaatccagggtctaaacaagacatttggttggtgtgattctccttttttttcttgttatatatgtgttgagtaaacaggcaaaaaaataaagaatactatattttacatttcagatttggcccattgaatctttatggtggcatctagcaaaatctcctatgactccttctgtatttacctgttaactgttcatgatatcttaaggcttgattgattgctgtgcaattttttggcaacaaaactgttgaattgtatcaggattcaataatctctgaaaataccactttttgtgatgttaagatttatcagtgggtccattgttaatggcctagcaattataacattgtttcctgtcaaccttttatcctgatagttttactcacccactagttgcctagattcattatttcatcagagtttaataagggtgacttatgttccatgcctattgtgtttttagtcattgaatacaaatgtttatatgtagttcaggacaccatttttccttataaatgtggccaaattgcctggcttgctgatgaatctctcttttttagcactgaaagtcttgcagtccatgaaatctctcattcagggccaatcagaacagttggtccccctgtgttccaatcaatagtttttatcactttttgttatatttctatagttaggacactgtggtatggtagaatgaacattggatttcaattgagatctgtgtgtgactctagactttcaaagcttaagtttcttggtgcatataatatcttctacaactccagtgggaggaggagggtatcaaagagcatataaatgtagaaaagcattatgcagatattaaggattattattctctatgtacattcttgttttttctctcagacttgaagcacctggctctttttctgtaccattttatatcagcctaaatatttaatattcagttttaactatatcccacatgacagtctaagctctcaacctctggcacttgttaggccacataggaaaaactgtctccagtcgtggataccacattggaataaagaagactaatattaaaagcgtgcacagagaaggtgacttggatgggagtgggcaagaaactatcgcatatgaaatatagttaagtgatatttgacattcatattaaaattatgtttaatactggatcatctgatttcctagactttaaactcctttgaacaggggataagaaagtgcttgacatattaccgactttgataaatatctttttaaagatcaaagaataataagcatgtggattagtgactgaggcctgaactgatattgctcagatgaggaaaacctatcaattgctttgggtagggcagaacctaagcttggactagaacttgagttgttttactcctattgcagaacattcctgtgttttcctcagcaaaacttccttcccctaaccccagggaaagttaaacagaaaaaaaagagttaaggacataatagcaatctacaaatatttgaatagaggggcatttccagttgatgtaagtaattaagggtgataaccacaggaactagagtgggactctgcctaagtatgagagagcgttccaacaatgacagctgcctcacagctcgaacagaggttggcaagcacttttcagaggtgttgcagaaagaatttgtatattggttgtttttaaagtccctcctaactgcaaggacttgttattctaggaaataaagtaatcatgagtgcaatctcccactatgctagaagtgtgggcatctccactggcaaagacccagctccacttcaactgcttctcccatcagcaccactggtgggaggaggagagaaagatttgggctttagttcttcagaagtctaatgctgtgggcagagcacttcttttcctatcaaaatgattggggcaatgaaactgattttgcaagcaaataggaaatatatatttattggctttgctttatgataaatatggtgttctttctttcattttcactccaatccttattacataccatctaagtagtaaaataatttcctgattgttttccctctgtccttccaccatactaattctctaattcaaggtttggctttatttcccttttgtagaacactgattgattgtatcatttgccctaattgctgggtctctcctttctttgtgatttacaccacgcttttattgttccatgtttaaggccctctaagactggcctcttattcagtaagaaagttgcttctccttccacatcagcattgatgcatcccccacacaaatgatatactctccaaagcagacagctcaaggcaatgtatgtgacttgaagcaatttgcttgacctctttgaacctttttattgttatttctaaaattagaataataaaatttaactcacagaattgttttagtaataaaacaccttacaaacggttttttaccaatgtcagtttcctttcattttccccatgctcccttctatttacccgcagaattattttaattggacatgccattcattttgtgcttaatataaattgtttcattacctgcctttttaaaggtttactagtgaaacaaatttgtcagattgaaactagtagtgctctttattttatattacatatgttgcaacttgaaaaatggtatgtgctgaatgttagggaaagccagaaaaattgaatttctgccttcccttataaaagattaagggtaaacagagaaatttacatagcaataaaggagaaaatatcattgttctttacattttatgcaacttaagcatggctatgataaaatgagcagtttgagtactgatactttgatagctgtaaagtggttaccacatcttcgttgcatctgtagtaattttctcagatttgacaaataaccaataattatttttcaattgcactttgctttggtgtttttgacctgctcttaatccttgtttatctcaatattgccttttaaggtgagctgtgtttaaagggttttcacaaaagctggagccattaccaggtgatctgagcaacaaatagactttgtggtcatttcaaacaatctgaaatatataaagtcatatcttcattccagagttagaactctttaggaaataaaagttttctgagaccacagcatgggaggttttttgctgatgctttgtttaccactgacatttcttccccatcatcttattatacaatttttgttctttagtgtttactttggcaggttatacattttctggtggagcaaagttaatttcatttcatccacatagacaaccattcatttagaccccaagctgctcaacgagttattatataaatatttgattaaaataatgactttctggctctcaagagaagaggcataaaaatcatagccccatttataaaccacactgcctcagtctaataaaacagcagtgtctgtaagagcctgacaagttaaaagtaagctcagtaacttcgaacatagtcttctatattcaataatttgaccctagacattttatttctggtatttctctttttatattttacatataaattgtacgcattctaattagtacatgtctataataaacatagcaatactaattgctttagggaatacaaattatttcacaccagcttgtggtctaaagaatttgcagtctagttggagaagaatgaatacagcacaaaatgttagatattgaaattaaaatggggctatgacaagcaatcatttcttagccttttctgacttctcagtaaaagacctatggagaccaaaagagtaacaaaaagagaaaaagtgatgaaaatgcatagctattaatggagtctagaggaaaatctaactagaaaactagattataactggatttagaacataatccaagcctcatactatgttgctggaaacagaacataccacttggtatgaaagaagggcatatggaattttccccaccttctatctgtaggttcagaaatgaaagttttgactgaagagattgttggaaaatcatctctctgtttcattgttactacttttggagacagccagagttctattcttgtcattctgctcctgcccccataccatcttttatactcatctgtaattaaagttttagaaagcagttaccagtaggcagggaatggggtggaacttacatggctctaccatagttttaggtaaagcaggagtagagagaatagtagcagtttatatataggcttatggtttatatatatatattcttgcaacagcccaatctgaggctaacaaagacatactccaaaatctctggacactcagatttggtcccggaaagtggatccaattacttaaacagaaaaaattgtaggaccaagggcaatgcacataccctacagctgggtacacatagagctctcctcatatgatgaaaaataaaaaacttcaatcacagacaactttcgaataaagagcttaaaagttcagcatttaagctcttttctacaagaatctagataaaatctagagatgttttttattttcttaatagcatttgtatagacaaaagccttttggagcccaaaagacatgaaaattgaacaccattcagtttaaaaggaaagagacagccattccctgacaagccttccaagatggcacaccaacaattctgtaccttttcccagccaaatcctgaagaagcctgagaagtaataaaaagttgttgcatcacagaaacataaaatctctcagaaacctacagagagataaaatcttgctaggtcctggtagagggaaaacagtccccaagagtagaagatggccaagctgttagcccccacgtagtctagcagtatgttggggagggaggttgttaactctgattttttttctctcacacattaaacagaaaaatgtatcatctcctccatcaccatcacaagagactactgcactgccaagccagtatctgctgcaggaagtggagtgatgggtaacttcaggatctagcctgagccagtttcttttgtgggagcataaagatgaaagaaaatggagccaggctcccctcatcctgacattttttgttttacacaaaaatctgtataggacattgctaccaaaagcttttctcagtcttgttttttacattttagatagcagagatagttgatctatcaaactctacaaggacccaattttcttcattctctttgttcccctttgtttgtcttcaacctctttgattcttacttgatatttctttctcatattactttgctaagagctgaagagaaatgctaacagtattgccacttcatgtactgtttttctaagttctcctatactacagtctaactggaggggtgtgtgtgtgtgtgtgtgtgtgtgtgtgtgtgtgtgtgtgtgtgtgtctgtgtttagtataacttgaatttctctcattttagcctccaatatgaatttcttgtctgttccttaaaagatctctaagttaataatatatattttagctttgggtacgtaagattgtactttattactaagctacatgtcagctattgaaataaagcctaaagttttattaaaacctgcagaattcagctacatcacaaatttaaatccccacttccagatcttgctgaaaaaaaatccagtgcaatcacctatatttttctgctccctcttatgtcaaataggtctgtgaagattttttttcttacaagtcaatctttgcctcagcccatcctgctgagacaaatgtctaagggaaccggtggtgacggtaacccttgagctgactcagcttgctaatggccaaaggattgggcagccgttatatgaaacgactcaaatgtttttgcctaggactaaagtggacctatagaaatatacattagctatatacaaagacaccataaagtctagtcactcaccacgttcagaatattctgtgaccagtttcatagctaaaaacctaccacagaacaccaaaattctgcctggataacacaggcctctaaagatcaccaaagcaaagttaccttggcaaaatgttaaaggttcacacaatctgatttgactagaaagctctcttgggttacttctctgtgaaattccacaccctattttgttctcaatgttgtctgacaaggtacaaaagattactgcttttgaaaggaactcaataaatagcgctctttttaaaagcaaggtctgagaaataaaagtcagtggatggaggccaacatccttgaaggcatccattgttctaatgatacagccagtccagattaatgttattgcctggagaagcagacttccctgctcgctgcaggtaccttcctccctagaagaaaaagggaagaactgtgccaacgatatccagtttattattgccaaagtccttcgtcagataaagccgccccttctattctgaagtaattaaagtagatcttaagtagggctaaagtcatgccagcagagtcacagcagaggtgttatctacacacaatagtcaggaatgtgggaaaagtgtttcccaatagtgaagataatcttagttccagattaatttgtgggttaaacgcaattcaaatgacaattttttgcaggctttattgaataatctgagaaacttattctaaaatgcatatgaaaactcagattctgaaaaagatgaacaaaatggggcacttatcctaccagatattaagacatactacaaagctttaataagataaaccatatggttattgtccgtgaacagtcaaatggttgagaaaatagagctcaaaaaaccatccaggtatagataggggtttgatataccacagtaatgactccaaaatccacaggctacagatgggtagtttagtagatgtatttgaaaaccaggctcacactaaagaaaatgttacaaggggactctacactatataaaggtaatctccaggaggatttaaggaactaaatgttaaaattatacctcaaaatgaagaatgtatagaagattgtgactttggagaagggaagttcttcctcccaaggactatagaagcacaaactgtaatgagaaaaaaagtcaatatatatgaccatgtcaagtcatggataattattcaagcacacaaaagttaacagattgagagaaggtatatgaagcatccaaatcaatgagatatgtgtcaaaaattatcaactaatataagtaagaaaaaataaaccaaaattaaaaatgaatgaaatataaaaatacaaaaaatgggaaatgacaacaaatatatgaagatatgctaatgcaaactcatcagtaatgaagtaattcctaattaaaataactgatacactgccttatgcttaatagattttttaaataaacaaattggattatttggaaatagggaacacaagtctttacgtacttctaattggtatgcaaactagaattggctctctggaaagtaactgacagcatttagtgaaattaagcatggcaaaatcctattgtccagcgatcttatatgttcagaggatagagaacttcttaataagttcacgagggaaacctatataaattcattcattgcagcactgcttgtgctatcaggaactgttagacaaatagatacccaaaactaagaaaatgagtgtgtatcaagtgatagaaataactgtgtagatggtagttgtaaagaatttgatgtacctaagttatatgaattcatttaaaaactcagtcttgactaaaggggggaaaacataagaacctataacactatctcatttttataagccaaaaatatgtatatgcatcaaatagcatatttgttaaagacacatacttgtcaaaacacccataacaaaacattaaagtcactgctatggtggatggaatgggattcagaattgaaaatttaaggggaaaaatgtgacagtcatcctactgatttattatatgacatagcatagactaagaaatatgattcattcaattatccgctttggaaattcaaaacaaaaaatcaacaaaaaatatctcagaaagagggataatctaaaacgtgctggcaaataaatgagaaaaagtgaaactatcattaaaagccaattgacattactataatttgatcagtaatgttaagatgcccttccagcatgaagagtaaaacagtacaagaaaaacagtgaggaatctcagaatagatatggagaacagaattcctgaagcagaaaccaaaacaactggtacagaagcaataatacaatgcaggagtagggaaaaaaattgaattaacattattcaactcaaagatcgtactgcattctgataaattaataaagtcaaatgattaaatggaaatacatgcttgtcacatcctatcaaatattttgtttttaaattacaagaatatggaggatggagagagatcacaattttactgggaaaatttatgtttataaggaatatgtgatgacctagcaaaatgttcagtgttacatatagtgcaaaaagtatggaatctgcttatgttggaaagagaactggaagttggaatcagagataaaaatagaaattataatgttgatcttaactatgtaagaaactataatagaatataggcaactttttctctgagtggtcaagttattagagatttttaaaatatctttttctgttttacaaaattctcacaatgtgcatttacttattttaaaatcaggaaaatatatagctaattttcaatattcaatactaataaataaatagcagtttaagagatgacattgctcagtagtgtaagctaagtatgggtagaggagaaaaaaaaaagcatgcaagtggacgcagccgtggaactgatacttagaacaagaccttactcattatatgtcctaagctaattacatatattaaaaacacaagtgataagaatttatgacaatggttttctcttagagaagtagctttacaaaggatttttttccagttccatcacatttgagaaatggagcattagtaattctgatgcacagtttattttttagtataccaaaaagcttgtatttgaacactgtaaatggaatatgaaattatacattaatcctcatcagatcccttaaagaaatttttgagttgcaatatactcacagttattgttttaattttattagttgctgatttgaagataatacagtattatatcaattaattattacaaaattaataatttggactctgagtatgcatcactacttctagatgctgtatttcttatacattaatatccactgtacattttgcgcttaaactccaactaaaatggggatattcttcacttatgttactactgcagctggggcagctgacgttataagcagccccctgaggcctgggatttctctttctttcctgaaggtgcctcaaggctgtgatggactgaggtgtccctgaagagacttagactagatgaatacatctgtgtggagaaaccatttaaaatctctgtttaagaacacttatgtttcttctaaatgttcttcctatgttcccttttactttgtatttacatcattaagaaaatcagaggtatcaggagaaaactgtaacaatgatcgttattaagtagagaagcatatttgtcacatcaaaaattttaaataatcttatatatggtgtttgttcaagctgtttgtgtaggtattcaaactgtttgtgtagtatgggaaattacaattttgctcctacttttttcttatgattgccaaacaaaagaagttgcaagagtcactgtgtttttctgtattagtcacccatatcaacactttcaacaaatatttatggcttatcttctaaaatcttgtcttcttctatgtacattcatcctgcttatatttaatagattataatattgactctaataataaaaattgagatgtattatattattcttcaaataatctatgttcttattttgtatacatattagtctgaactatttgacaataaacaaaaactgggttgtcatgtcagacagcttgataaacactgcactagggtctaaaaaaaaattgtagggtagtagaaagaatggcatggagggagaaatttaaaacctatgacatttttgaggctgctgtagaccccagctgtcagagacaatataaagttataaaaagatcagtattagaagtgcctggcctccatttaaaatagtaagccatgtacagtgtactaaacattaaaaaaaagtttcctctgtccagttgctgcacttctgggaacttctttccctccctctagcacatctatgcagattccatgatctccatgctggcttcatggatatgtgacctatgcagtttcgaagggcccccctacacatgttttaattctctgccatggctcgttgaaaattcttaataagttttgaacaaggtaacccacattttcacattgcacttggctatacaaaattatgtagcagtcctgccgagtagctgtgtctgtaggatatgaccaaaccctccagccacattgattagtgcaaggctgggtgccagactaaagcctcgtcaactgtagaattcgaaaatttcaaatttgggtgtcaataatgttagcagcactgaagattcacaaacttctacagagctaatctggttcttttctttctgaggacttattttcgactacttattggatcttctgaaagactattatccttatgcttattttcttttttctctaagtagctggaataggttttcgttcttgcaattaaaaacaatagctaaaatacatatgttatagaatgagagaagggtaagaaacagcgttggaaattacattttaatgaaataaaatattctcaatcttaaagaaactctgcttcctaaagagaattgaaaacaatagacttggggaaatcaacaactgagaaggctctaaggccacaccctgaatttaggggaaaccgtctgagttggggaggtttctcccaggaccaccaagtgtgtcctggtataggacattttaaaaagttttttgaatggagaactgacttaaaacatcttacaaaaatttaacctttttgattctccgttgtcccagcctctcaccactcattctcttgagacacagaaaaatgagtagaaaaaaaaaaaatcaagttcttttatcttaaatgacatgttagtaagaagcattcttacttcagatgtagcacaaatcaaacaacaaaatgaaataaacttaccatatgataaccatgaatagctacaaactgaaatccaggaaacatagctcccaaaatagaacaatattttccaaaagtacttctagctataaaaaaaaagtgttaaatatgaattaaatgagtgaagagttcaaatctgaaatattaaaacaatagaatggtatgggcataaaaattgaacacttattgaaatgataattaaagcaattagataatcaagagacacatcgtttttgactgaaaatcaaagtagtgttaatattagtaatattgtttttcacacatcctaactctcaatctcaattcttcccttctccccccacctctgtccttctgtctctctatctatagagagatgtttgtggcaacgttgttcatctttgccattgtggaaaaatcgccccaaaaattgtggtaaattcttgctatgcatttattaaaaatgggagtgtgaatttcagcctggagagttatatcatctaaagtaaaaatatatatttataataatatatagcatatcatttttgtaataaaaccaaaattccctttatatgtgaatgtatattagaatgatcatgtagatatatataagaatagagaaaaggaactatagcttacttcaaattatacaggctatgtaagagagactcataatttaaatcagtcatttttaccccaatctcatgttgtttttctgtgaaaccctattatctaaaacatattgaacatcagttaatgaaggaaagtgcaactcaaggggttactggtagtgaaaatgttgtgaagtactgatttttaagatttttctctttcattgatgtaaatgaaatttgataattattagtctgtacttaaatataggcatttaattgctttatgttttctggaaaaaatattaactaataaattagcttgggatctggcatgactgggttttgcaatgcctggggataaaatgattttaggatattataaattgtgctctcacttttctagttctggaaagaataaataaatagatattttagagaataaaaaaaaagaaaggcaatgcaggattactaataaatattacatttgggatcttggaagggatgtagaaatgagaacccttaaagggaggctttattggccaaatggtatatctatttctgttgagatttactttgtcccttcttcactggggaatcatgttgaccatttctcttttaggcacttttattgtcacaaacaaatcacaacaaatcacaattttctttataacagtgttagcaagtgaaattatggattacatatttttgtgacagtttgagaatatcaaaacagaagtgaaatggttaaatcccattaatattatttatactgaatttatactcatttatgccaaattattactacatcttcaatgagttgaaagctgcggttcaattattttatgcaataaccattacaatatggtagactacctgcttctactgagtcatttctgtttgttaggaatttcctagtttatgatgaacttttaaaaaaaatttagattctatcttatgagaaacctacagcccacatcatacttaatagacaaaagacggaagcagtctctttgaaaactggtgccattcttaacaatcctattcaacatagtactggaagttctagccagagcaattgggcaaaagggataaataacaggcatccaaataggaaaaaaggaagtaaagctatctcttcattgatgatatgatttttttaccaagaaaaccctaaagactattaataaggcccctgaagctaataaatgacttcagtaaagtttcaggatgcaaaaccaatatagaaaaataagtagcaatatatacaccaataatgctcaagctgagagccaaaccaataatgcaatctcgtttgcaatagccacagaaagaataaaatacctgggaatacagctaaccaaggaggtgaaatatcattgtgaggagaattataaaacactgctgaaagacgtttgagatacaaaacaaaacaaaacaaaaacaaataaatggaaaaacatctccagctcatggattagaagaatcaaaatcattaaaatggtcatactgcttaaagcaatttacatattcaatgttattcctatcaaactaccaatgtcatttttcacagaattaggaaaaattattctaaaattcatttggaagcaaaaaatagcctgaatagccaaagcaattctaagcaaaacaaaaaaaacaaacaaaacaacaacaacaaccaaaaagctggaggcatctgatagggtttggctgtgtctccactcaaatctcatcttgaattgttgcccccataatccccacatgtcacgggagggacctagtgggaggtaattgaatcatgggggtgggtttttctcatgctgttttcatgatagtgaataagtctcaagagatctgttgcttttataaagagcagttccccagcacacgctctcttgcctgacaccctgtaagacatgcctttttcttccaccttgattgtgaggcttccccagcaatgtggaactgtgagtccattaaatctttctttctttataaattacccagtctcaagtatgtctttattgcagcatgagagtggactaatacacatcgattacccaacttcaaactatactacaaagctacagtaaccaaaacagcatggtaccggtacgaaaacagacccatagaccaatgggacagaatagagagcccagaaataaagctgagcacctacaactatcttatctttgacaaagtcaacaaaaaaaaagaaatggggaaaagattccctatttaataaatggtgctgggctaactggctatctatatgcagaataatgaaactggacccctacctatcaccatatacaaaaattcactcaagatgaattaaagacttaagtataagacatcagactataacattcttagaaaaaaacctaggaaatatccttcttgatactggcgttggcaaataatttatggctaagtcctcaaaagcaattacaacaaaaataaaaatttacaaatgagacctaataaagagcttcttcacagcaagataagtgaccaacagagtaaagagacaccctatagaatgggagaaaatgttcacaaactatgcatttgaaaaaggtctaatattaagaatctataagaaacttaacaagcaaaaaacaaaaagttggcaaaggacatgaaaacacatttctcaaaagaagacatacaattgaccaacaaacatatgaaaaaaaatactcattatgactaattatcagagaaatacaaatgaaaactataatgagataccatctcactccagtcaaaatggctattaataccaagtcaaaaaacaacagatgctggtgaggctatggagaaaagggaacattcatacactgttggtgagaatgtattaataaattagttcaaccactgtggagagcagtttggaagtttggagatctctcaaagaactgagagttgaactaccactggactcagcaatcacactacttgggtatatacccaaaggaaaataaatctttcaccaaaaagacacatgcaccttgatgttcattgcagtgctgttcacaacggcaaagacatgcagtcaactcaggtgcccatcaacagtggattggataaataaaatgtggcacatatacaccatggaatactacacagctgtaaaaaagaaaaaagtcatgtcctctgcagcaacatggatgcagctgaaaaccattatcttaagcaaaataatgcagaaatagtcatatattgcgtgttctcacttttaagtcgaaactaaacattgggtgcgcatgatcataaaaataaaaacaatggacactgggcaatacaagaggagggaggaaggaagcaggatgggtaagcgttgaaaacaactacctattgggtactatgctcactacctgggtgatagattcattcttactcctaacctcaattatgcaatatacttatgtcacaagtctgcatatgtgccccctgattctaaaataaaagttgaaaagaaaaagatttatacatgaagagcagacttccatgttgtaaaacatattttgtatttattaatttgaaaaatgttactttttgttgagtactgttagtgtttatgtgaacaataattttagtgaactgtaggtaggtaatttgtaactaatataatagtgattcaatttggaatcaattgttcagtcatttgacattttttgtcctaaaggtaaccatgtaaacttaaatatgaaaaaaacacctaattgtatattttattggtcttaatgagatgattttagctaccaaataagaacatttaaatctgggttttcctctttctcccattttaatgtttacaactttgtgttctctcaactgtataaaatatattctaattagaatttcctgatgccaaaaaatttagattctctcctgattttactttttcttaagatgactcactacgtagatgttttctagcacaaaatgactcagttaaaaaatctaaaagattatgtgatacaaaatgggaaaattaaatttacatacacaataattatggttatcagtatctgaaaggtaaggatgaaatatttcatttgtgctacaactccatgtggccatatagtatggtatagcactatcatcatagaaataacattgcatttgtcgaccttaaatagtaagtgggtgtcatagaccctagttaatcatatttgactggggttttaaaaatgaaaaatttattttgctactggacacaataatttactaagaccctgcagatcctcctttaaatatattttttatggtggttattccctgagattgtatatgactagtttctgttatcctgacagctaattgtaaatcaaaaggaaaagcaaactttaaaaaaagatttctcctattattttgatatgatggattctctatttttaatgtttctaaacaaaataaaatgttttgggtaactttcaaaaacaaaactggaagttcatttttactaacatttaatgagttataataatgaccagctcctgcttgtgtccttttaagtgtatgaatttctaggttaatttttaactttgggtaaggtgaaataaaaaaaaatatataatatatctatattaatattaaaatatatataatatatgtatttaaatactctcttgtaattttcctttttaaaggtgcttactgagtagattttgttctagcacaaaagtgactggttgttttaactattggagaaaggaccttgatgctgtggagtatttcgttgatagctgacagcgtcttgaatgcccttccagcctataagcaagctgcacttcataaggatcctaagggaatcagcactcccaactttggtggcgtttcagggttggctggagcagagtgctatgggcacaccaccatggtcaaaactcaatcaggaaatgcaggatggacatatccaaaggagaacaaagtaaagaataataatcattgtgataagaagccagtgttgcaggcaggaaaatcatagcttgcataaataaaaaagataagccaagcacagaaatgtgaatgagaaaaatccagagcagtgtggtcaatctgatgtataaagcaagcctctaatgtgagccacatacctgatttttagttttctgttatcctaatttaaaatgtaaaaagcaacaggtaaaatcaattgtaataaacattttatttccctgtatatatccaagtattaatatttcaacacataatcaatatagaaatttaaaatgaggtattttaagttatttagttccattctaagacttcaaaatccagtgtgaatttttcacttacacaacatcttatttcagagtagccacaattcaagcgctcaatagcacatgtggctactggttgttgtattgacagtgcaggcacaaattcataaaggtgatttaatgggttaaggtgagagaaagaatctagaattaatccatagatagcaagcggtgccagtgcccattttgctttaatgcataacatgggggattttaagtattctaaagcctcagttctgctcttgcttctcctgcttactcattttttgaacctcaaatttattggctatgtaaataaaaatattacattatatgctcaatatatacacctgagctatcctatgaaggagcaccatggatggtctcaatgttagtcaaaatattatataattcttagcctattacaaagttgggagaaaaagaggatattgaaactgagagtagttatctatctagagcaaattacgtttttatttttattgattttctccattgcttgttaaatagggaagtgtcacaggtaagatccggaattactgtgtttctatcaattaactttggaattatatgaagcaattacattaagcaaaaatattagattctgttctaattaaaagtaaacattaaaagtttaagacataaactacattgacattaacaatgcttgaaaatagtgtttcttcctttaaatgcaggaggaaaaaataccatccaagggaatgtgcagttaatagagcaaaacaaatgattcatcccagtgggatgaagagacagaagatcagtggtccaatgatccccgtttcttcaacaaaataaatgtaaatttctgacatgctattattaaaagatgtgtgctttttatactgtataattagaaatgagggaaatacagcattctgtccatcagccatctgtttatttacaatcagccatagctgtgtatatcggaggaacaactttgaacaaggtgaaaacatgtaatgaagattaacatcatgaaagcttcatgtgaactttatgtctccttcatagtagttcacatttgtctaatttggaagattacatttggaaactgaacaatgaagttatttaacttgtagtggaaaaaaacactccaaattttgaattgaaatgattttggtgtagcaaatatgccacattaccacattaaaatttaaatttgtgctctaaatgaaaatgtgcccttatcctgaaaaaagggaaatttcctatggtttgttaaattttctcaaatactctgaagttctctccctacaatggagaggtttggctcacaaattggatgtgagagcacctaacctctcattgaatcagcttttctgtttctgtaaggctgtagaaggcaggatttctttccttttttttttttttttttttttgagacagagtcttgcaccctcacccaggctggaatgcaatggcgcgatctcggctcactgcaacctccgcctcgtaggttcaagcgattgtcctgcctcagcctcccgagtagctggaattacaggtgcctgccaccacgccaggctaattttttgtatttttagtagggacggggtttcactacgttggccaggctggtctcaaactcctgacgtcatgatctgcccaccttgacccccccaaactgctgggataacaagcgtgagccactgcgcccagccaggatttatttcttagtgtggcgtactggtacgtgttcaacagtcagttctccagaagaaaaaaatagccctgatttgcagtgttcgtcaatttcttcccatgtggcctatttcaacttaccaacatgatttcactgaaagcaggggaaaagatgtgtacgtccaacacaccactgctaccctccctaaaatgcagtttttatttctgtgacattaagatcagtggtcattaacatagtgctctctgagttcttccgctggcagcaagtaaattactgattcagaccacactttaagcaaatggactttgttcttgtgaatttccattatcataaagtccaaggcacatttttcagatttgaacatcttgcaattttcatcatttcaaactgagttttcttggtggacttgtattttgtgtagctttaacttttatttccctactgattaatcagtagaaaatctattcacatgtttattggcatttggatatcctcttttgtgaagtgcctttcaaatatgttgtctgagtttcaactttctgtggtcttttcctccttgagcaccttgttggtactattaatatatgctacagatagccatatatctttcccactccttatttgttaatgtctcttgatgaacagactttatgatcagtgtctcttttttcccctacttaacaagttttcccagttctgaaatcataaaaatgttctcaaagcttaagtgctttgttttcgactttgaaatgtacaatccaaatggaaaatattgttctgtgaatggtataagataggagttgtttcatgttttttacatatgtggattaaattgacccagcactaattatttgaagactgtcctttacctaatgctttgcagttccatctttgtcacaaatcaagtgtctatacgtgtgggtctgtttctgaaatctattgcattggtctatttatttattttgtaacaatattgttttttattaataactataacattgtaatgatagaagacattttcccatgtggtcctattcaagatttccttaggtgtcgtcattttttaatatacatttttggaaatatactgaaaactcatttataataaccacaaaaattatcttgataatgaactctgtaatgataatctgatttcatttctgctgctgtttatttgtgctgtatctccttttatttcttaataattctagtctgaactaatcaattttattagtttttttttttcaaagaactatttcggctttgttaatttgtacagaaatgtgttgttttctatgttttttttcctagtctcattattaatattttcttcagtctacttcttgaagttcaaccaaaatttattcaagtttttcattcaatatttggtttcagtaatttttagcttcatttcctaatatattaattttaaagctatgggtctctctttaagtataactttgccatcattaaaatgttcttactttgtgtgtgtccgtgtgtgcatgcgtgcatgtgtgtgtgtgtgtgtgtgtgagtgactgatagggacaggaggcagggaaattctgggcagaagagggtggggccccggtgagtggcccacccacaagcctggaaccacggcccaaaaagagaacatacattcctgttttcctggttgactgttgccttttccaaaaccactcatggcccacccccatgccaaatcctgtgcccttaaaaaccccaggctctgcaggcagaagagggagaaaaggagaggcagtgggacatgggagactatggttggatgttggagagaagcagcttgacttcagagggatgtcttgatggtgtagtttcagagaggagtcccgccagggattatcttcctactctgcccacttttcagctcccctttccactgagagccactttcatcagcaataaaatcccccacatttttttttaagatttgtaaatggaatgaatgcccactagtgaagagaaagtgctacggactggattgtgtttcatccaaaatttacatgttgaagccctaattcacaatgtgactgcatttaaatataaggctttcaggaggcaattaaagttaaatgaggtcaaaagagtaggggcggccgggcacggtggctcatgcctgtaatcacaacattttggattctgcctcttgggttcaagtgattctcatgtctcagcctcccacatagctgggactacaggcacacaccaccacacccagctaatttttgtatttttaatggagacgaggtttcaccatgttggccaggcgggtcttgaactcctgcctcaagtgatcctcccacgtcagcctcttgaagtgctgtaattacaggagtgagccactgtactctgccaagatttttacatttttattggtatgtaataactgtacatatttatgtgtagatgtgatattttgatatatacatacaatgtgtaatgatcaaatcagggtattgagtatgtccatctccttaaccatttgtcatttatttgtattgggaacattttaaatcttctagctgttttaaaatatacaataaattcttaactgtagtaacactcctgtgctattaaactattaaaaatttttgaatatatatatttcactgttttaaaaattcatatttttttcacttacagtttgaaaaatatatatctcaaaaatttttctttgtaatttctcctttgatcaataggttgtttataattcatctcttaattcccaaatatacattaattcaaaaatttttggccaggcatgatggctcacgcctgtaatcccacaactttgggaggtcgaggcagtcggatcacaaggtcaggagatcaagaccatcctggctaacatggtgaaactctgtctctactaaaaaatataaaaaattagccgggcatggtggcaggcacctgtagtcccagctacttgggaggctgaggcaggagaatggcgtgaacccaggaggtggagcttggagcttgcagtgagccaggatcgcaccactgcactccagcctgggtgacagagcaagactccatctcaaaaaaaaaaaaaaaaaaaatttggttatggatttacttctttgtgatcagagattagattatgcatgactttaatgcactgaaattcactcagtcttattttgtgttcaacatatggcggagatctagaaattttctatttcccttgaaaataaggtacatttattttggcagttctgcagttcctatgcatataattatacacacacacacactcacacacacacacacacacacacacacatcaacaaggccaaggttgctaaaagtatagttcaatcttctgtatatttgttatgttttatcttcttgttttattggtgttggagaggtgtgttaaaaaacttctgaaatagttgtgaatttgttcatttatccatgtatttctgttaatgtttgctgcataaatataacaccgagggaacacaaattgggaattgttatatatttgttattatgaaatacgcttatttctaagattttgttttgtttttaatacaatctaattcttttttctgttgattggaacatgtattacctttacattcaatgaaagtaataatttattttggtttgaattcatcaactttctacttacctatattcttaatgtacattctatttattctgtatccctttttgtctcattttttagtttttaaaagacactttaaaaaatctttttaaaataggttttgaacacaaccacttacattattaaaccaaggcaatggtaataggtcccagaatccagttgtttctgctttagagagtgagataggctttttagaaaacatagtcacagactgttctatttgccctgtgtatttgtataagggtaaccagaagtatttactttgagataaactctactctgactggctaagaggacattaaagactacacaattgtctatgacaactttagtaaatctatttaggcgatttttttttttttttttttttgctttctgagcagaagtgctatcatttattactttaaggctaaaaataagttttgaaacagcttttcaagttttatttttatgaaaattatagcttgaagaatatacatgaaaagacaatatctcttctggaagttttaaaattaattttaaatacttgagtttattttattttgtagccttctaggtattatatttaagaaaatataattcactaatgggatggttgtattattttctgttactttaacaaaatacctgaaactgggtaatttataagtaaaatgaatttactttttatagttacagaaactggaagtccaaagtcaagggaccacatttggagaggacctttttgctggtgaagtctctgtgcagagtcccaaggaggcacagggtatccatggtgagggggctgagcatgctaacgtacttgctcaggtctctcttcctcttcttataaagacaacacttccactcccataattcagtttattgacccattaatttataaatgaattaatccattaatgagagcaaactttcataattgaatcacctcttaaaggacccactttttaatactgctgcattggggattaggtttccaacacaagaaatttggggtaaacattcaaaccccatcaatggtagttttcaacatctggaaatttctaacgattactccaaatacccaggataagtaagagtgtgctcaacagatataaggctgatcttcatataagaaacagtatcccagtgaagcgtacgttgtatgaggagaataagtatcatttattgcaatagaaatgtcaatttatgtgctttgagttggacaaattccttgagtggaattagacagtttctgtaaagtaggccagattatctctgaagaaagaaactgtgatagcttagacccaatattagtgcctattcttgattgactaggccttgttgataggattgtaatgaccttggcggaagcattttgctgttatgaggtcaaggttcaatttgcaaaattgaaggtgaggggagctaaagtgccaagaatgtcctgttaaagagaatttgtcttttgaagtatttcagagaatagctattaaattttatcagcaaggttaaggaacaagtgtcagagccagaaatccattagatttagagtagtagctatactctggaaaaaaatgtgtaagagttttgcttttccttaagtggtaaaaggtgaacagatggggtcacaaaaataagatgaatagaaaagggagcatatcagtgttttagcagagatcatattggaataataggcaagcttactagcagagtagaaggactgaaaggggccttctacccttccgaagaagtaaacagcttctaaatgattcctaaccccccacccccagcctttttttaagatttgtaaatggaatgaatgcccactagtgaagagaaagtgctatggactgaattgtgtttcatccaaaatttacatgttaaagctctaattcacaatgtgactgtatttaaagacagggcttttaggaggcaattaaagttacatgaggtcaaaagagtaggagcagtgggtgcagtggctcacacctgtaatctcagcattttgggaggcagaggctggtggatcacctgaggtcaggagttccagaccagctgaccaataaggtgaaactctgtctctactaaaatataaaaattagctgggcgtggtggcgcacgcctgtagtcccagcttcgtgggaggcagagacaggagaattgcttgaacccagaaggcagaggtttcagtgagccgagatcatgccactgcactccagcctgggtgacagagcaagactctgtctcaaaaaaaaaaaaaaaaaaaaaaagagtaggggcataattctatagaattgatggccttacaggaagagaaagagagagatttctgtgtctgcatgtgtacacattggggaaaaacgatgtgagaacacagcaaatggtggctgtttgcaagtgaggaaggaggcctcaccagagtccgaccatgctggcaccctgatctcgggcttctcagtctccaggctgtgagaaaatagatttctgttgtgtgagccacccagtctatggtaacagactaatacaggaagtaataaacatcttttgaggtaggaaacatgaatctgaggatcactactttggagtcttactgttgtgtcagttgttaacagtacctgataagatccttttcactgaggttcaagtgcaggttttttggtgtcttttccagaagattacattttcagattatagatcatttagaggtgggtgttttagaaatgttcttatctgttgatctagagctagagatatcctgagtccgtgtagtactagtcatatctgtttgtaattgagtggaatttaagactgttaatgaaatttccaaatgcctaaggtagcctgttattaatcaatcaggagagatgatataggtgtcccagatggcttggcccatagaaacattgaagctaacaataatactttaggccatggaagtttgagggttcctgagaactttcataattttagttttataatgccatagttcccttaattcttcttcaggactcttgataaaaaaagatggtgaaatttcttgataaaagacaaaacctgcttttcagcattccttaacaagaatgctggaaaaacaaatgtctctgtcagtagaaaggcagaaattcctcaggttgaaaaacaaaaccaagcatttttggggtcataattaatggccatgcattccactgtatgactataaaacacattgatgatccatctatcagttgatggatatttgagttatttctgctctttggctactgaaataatattgctgtgcacattcatgcacaagttgcttctaataagttagattttcacatatggttatataactagtagttgaatagctgggttatatggtttctacatgtttaatattttggtgaactgccaaatttctaagtgtctgtaccattttagaacctcatcagcaatttatgaggatttcagcttctccacatgctcatcaacacttcttattgtctgccttttgattttagccaccctagtgaatatgaagtggtatgatatctcattgtgattttgatttatatttcccaaatgataaattatattaagtatctttctgtgtgtctattgatcattaatagatattctttgagaaatcttttgcctatttttaaactgggctatttttctttttgttgaagttgacagttctttattaattctagacacaagtcccctattaaatatatgatcacaaatattttctcccattcttttgggttgtcttcactttctttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcctgacctcgtgatccgcccgcctcggcctcccgtcttcactttcttgatggtatcctttgaaatacaaaaagttttttctttttaattttgataatgtccaattcacttttttcttttgtgacttgcgcttttaacatcctagctaacagaccattactaattaaaggataaaatgtactcctctgtggcttctaagaatttttatagttttacctttcacatttaggtctatgattcatatggagttaattttcctttatagtatgaaggattctaatttcattcttttgtatgaagatattattgtcttagtaccatttcttaaaaagctttatctccccccattaaatatcttagacccatttttgaaaattaattgacctttagtataacagcttatttctgtactctcagttttgcccattgttttgtatagctttttctatactgtaccacactgttttgattactgtagtgttgtgggaagtcagggaccctgaacggtgggaccggctgaagccatggcagaagaacataaagtgcgaagatttcatgcacatttattagttccccaaattaatacttttataatttcttacgcctgtctttactgcaatctctgaacataaattgtgatgatttcatggacacttatcacttccctaatcaatactcttgtgatttcctatgcctgtctttactttaatctcttaatcctgtcatcttcctaaactgaggaggatgtatgtcgcctcaggaccctgtgatgattgcgttaactgcacaaattgtttgtagagtgtgtgtgtttgaacaatatcaaatctgagcaccttaagaacaggatagcagccatgttcagggaacaagggagataaccttaaaggctggctgcctgtgggcctggtgggacagtgccatatttctcttctttcaaaagcaaataggagaaatatcgctgaattctttttctcagcaaggaacagccctaagaaagagaatgtgtgcctaggggtaggcctctaaaatggccactttggggatgcctgccttttacggttgtaaataagggatgaaatatgccccggtctcccatagcgctaccaggcttattaggacgaggaaattcccgcctaataaattttggtcagaccagttggctgctctcaaaccctgtctcctgataagatgttatcaatgacaatgcatgcctgaaacttcattagcaattttaattttgccccagtcctgtgatctcaccctgcctccacttgccttgtgatattttattaccttgtgaaacatgtgatctctgtgacccacaccctatttatacactccctccccttttgaaaatcactaataaaaacttgctggttttgcggcttgggaggcatcacggaacctgccaatttgtgatgtctcccctggacacccagctttaaaatttctgtcttttgtactctttccctttatttctcagaccggccaacacttagggaaaatagaaaagaacctacgtgaaatatcaggggtgaatttcccccgatactatagctttgtagtaaatattgaaactggaagtgtgacttctctgactttgttttatttttcagtgttgttttgactactcttgattccttgatttttcagatgaattttgggatcaacttgtcaatttctacagggaaggagacaggaaggatttgattggaattgcactgaaactgtagatcaattaataactattaccatcttaatatttaatcttacattacgtgaacaaggatgtctctccatttatttagatattctttaacatctttcaaagatattatctagttttcaatatataaaatttgcacttgttgtattaaatcaattttttttattctttttggtgctatgataaatggaatttatcatttagttcattgctagtatatcaaaatacaattaatttttatatattgatcttgtaccctgccacttagctgagctcatttattagttctaatgatacttatagtgtatgtgaatcatttatgattttctatatatatatcatatcatctatgaatatagttttaatgttcccttccaatctcaaaatcttatattcctttttagatatatcttctttctttcttcatttgagtaatttgagacttttctctttttttcatcagtctatataaaaagattttaaattttttgtcaggtatttttaaattgatgtataatagttgtaactatttgggagctacatgtgacattttagtacctatatacaatatgtgaccatattgtatatgtgatatttagtacctttatacaatatgaccaaatgtggataattgggttggatattcatgacctgaaacatttatcttacttttgggttgggaatattataattgttttcttctagctgttttgaaatatataataaattattgttgactataattcctctactttgctattaaatattataacttattttttaaactacttttataccccttaaccaattcctcctaattccccatcttttcttttcagtctctagtaaccagcattctactctacttccatgagatctgcttttttggctctgatatatgagtgagatcatgcaatatctgtccttctgtgcctgacttattttacttaacctaatgacctccagttccatccatgttgctgcaaaagacaggatttcattcttttctatggatgaacaatattctgctgtgaatatacaccacattttctttatccattcatttattgatgggcacttaggttgatttcttgtttttgctattgtgcatagtgttgcaaaaaatgtgggagtgcagctatctctttgatatattcatatgctttctattgaatatatatccagtagtgggaatactggatcatatggtagttctatttttagttttttgagcaaccttcatactgtattccataagagctgtattactttacattctcaccaacagtgtacaagtgttcatctttcttctcatctttgccagcatttgttattattgtctatttgataatagccattttaactggaactaggtgatatctcattgcagttttgatttgcatttccctgatgattagtgatgttgagcatttttttcatatattcatggtccatttgtatgttttcttttaagaaatgtctattgagtctttttcccactttttaatcagatttttaaatttgatataaggtttcttattctgatatattgataatattctgattattaattgcttgttggatggatagattgcaaatagtttctcaccttttttttttaggatgccttttcactttgttgattgtcttttgctgtgcaaaagcttgttagcttgatgtaatcccatttatttttgctctggttgcctaagctttttgggagtcttactcaaaattttttgcccagaccagtattctgtagcatttcctcaatattttcttctagaagtttcatagctttcagttttacatttaagtctttaatccattttggcattcattttatatatgttgaaagataggaatctggtttcattcttctgcatatggatatccactttttccagaaccatttattaaacactgtcctttccccaatgtatgctcttggaaactttgtcaaaaattacttggttgtaagtgcatagatttacttctgagttctttattttttccattggtctatatgcctgtttttatgccagcaccatgcagcttgggttactataactttatgctataatttgaaatcaggtagtgtgatgccttcagctttattctttttgattaggattgctttggctgttgtggctctttttgggttccatacaaattttaggatttttttctgtttttgtgaagaaggtcattggtattttggtatagattatattgaagctatagataactttgagtgatacaggcattttaacaatgttgattatttcaatccatgagcatgagatatctttccattttttttctgtcctcttctatttctttaatcagtgtttcatagtttttcttatatagaatcattcactactttggttaagtttattactaggcaaaatttgttgaagctattataaattggattgctttcttgatttctttttcagattgattgccgatagtgtatatagtgctactaatatttttatattgattttgaattctgcaactatacagagtgtgtcagttctaaaagttttttggtagtctttaggcttttgaaaatatgaaatcatgtctgtaagcaaggctaatttgatttcttcctttccaatttgaatgccctttatttctttctctttcccagttgctctggctaggattcacagtactatgttgaatagaattggtgaaaatgggaatacttattttgcttcagatcttcatggaaaggctttcagtttcttctcattcatgcctttaacatgttaaagaatgttccaactatacccaattttttgagacttttatcaggaaaagatgttacattttatctaatgcttcttcagcatttattgagataatcatatggattttgtcattgattttcttgatacgatatatcacatttattgatttgcatatattgaacaacgtttgcatccctggaatgaatcccacttgagcattgtaactggtatttttaatgacttgtgtttgatttgcttgtattttgttgaggatatttgcatttatattcatcagggatattgacctgtagttttatttatttgttgtgtccttgtctggttttggtatcacagcaatgctggccttgtagaatgagtttggaagtatttcctcctcttcaattttttgaagagtttgagtagaactgagattagttctttaaatgttgggtataattcagcttgatactgtcaagtcctggacttttcttgggtggaagacttttttattactatatcaatctcattactcattattggtctgttcaggttttcaatttcttcatgattcaatcttgattggttgtgtgtgtttaggagtttatctaatttttctagattttctaatttgttggtatatagttgttcatagtagtctgtaattatcttttgtatttccatggtattagtaataatgtttcctttctaatctctgattttatttatttgagtcttatctttttttcttagcctagataaaggtttgttgattttgtttatctttgcaaaaaacttttcattttgctcatctttttaattatttttagtcttaattttatttccactataatttttattattttttttctattaattttgacttgaattgttcttgcttttccatttccttaagcttcatcattaggttatttatttaaagtcttcctattattattattattattgtttttaacatgggcatttgttgctataaactcttttggtactgcttttgctgtatcatttaggttctggtatgttgtgtttccatttttatttgttttaagaaattaaaacaaaattattcactgacctgttggtcattcaagagcatattgttcaatttctgtgtatttgtacagtctccaaaattcctcttgttattaatttctgtttttgttctgctgtggttaaaaatggtacttgatatgttttgacatttttgaattttttgagatttgtattgtgacttagcatgtggtctatcctggagaatttgctgatgaggaaaatgaatattctgcaatagttgggtgaaatgtactgcaaatatatgttaggtctatttgctgtagagtacagtttaactctgatgtttctttgttggctttctgcctggataatctgtctattgctgaaagtagggtattacagtctcttattcttaatctgttgcagtctatttctccctttatgtctattaatatttgctttatatatctgggtgctctggtgttgggtgcatatatttttctattattatattatctggctggactgaaaccttcagtatttatgtaatgacccctttgtctattaagtttttaactttaagctattgtatctcttgtaagtatagctactcctgctctgttttggttttcactgggtttacatttctatggagtatgtttttccattccttcacttttaatctatacgtgtctttataggcaaagtgagtttcttgtaaggagcatagagccgagactcgtttttcaatccattctgccatactgtgtcttttaattagaaaatttagtttatttacattcagtgttattcttggtaggtagggacttattgctgccattttgttgcttattcacagttgttttttaatgcctttcttttttttgtttctttttttctttcttactatgttcctttttgatgaagtgatttttttcagatagaatattttagtgtattgcttttgtgtgtctattataggtttttgctttgtggctaatatgatccttacaaaaaacctggtgtagttattacaaattatttaaaactgatgccaacttaactttgcaaaaaagaaaagaaacaaaaaacctgtatacattaactcccttctcctccaaaattttgaattttcgatgtcacaatttgtactttttatgttttctatctcttaacaaattgtcattattattatttttaatacatttgtcttttagttgctttggtaaaaatataagtggtttacataccacaattacagtataattgaaaaaattacaatagtgtccttttgttctttttgattggaagaacttcctttagcacttttttgtaggacaggtctggtattgacaaattccttcggcttttacttgtctgggaacgtctttttctctcctttatttctaaaggatggctttgctggatacagtattcttggtcagcagggttttttgtttttatttttttcttcttcagccctctgaatatattttctaaattcctagaagcctataaaatttctgctgagaaatctgctgccattcatattgaattccctttatatgttatttgcttcctttgttttagtgttttcaagatcttctctttgcctttaaactttgataatttgattatgctattatcttggttacccttatgtgggatgaacctgattaatgaccttttcacttcctgtccatggttatttatatctttatttatgtctagaaagttttgtgtcattacttctttaaataagctttctactctcttattctttctcagtttcctttttaactccaatatctgaatattggagttaattccaatacctgaatattggagttaattccaatacctgatatttaattctaatatctgaacaatatcttttgatattgttccatagatcctgtaagctttgttcattccttttgatttttttttctcatctgactgtgtattttcaaatttattcatccatttattagaaatggatgataagttgctctcactgtgttgctcaggctggtgttgaactcctaggctcaagcaatcctcctgccttgacttcctaaaatgctgggattacaggcatgtgccaccacaactggccttgattatgtattttcaaatagtctgcttttgtgctaattctcccttctatgactaattctgctgttgtgctcttcattacatctttttcatttcatttattcttttttcatctccaggttttctgtgcgtgtgtgtgtgtgtgtgtgtgtgttttaaaatacttcaatctctgttacatttctatgataagtttctcaattgattcttagtgttttcttgaggtttgttgagcttccttaagatggctattttgagttctttttctgatagactataaatctctatcaatttagggtcagtttctagcaccttattttgtttgtttggtgaggtaatatttctctgaatgttcttgatgtgtttgtacctgtgacaatgtctgtacatagagggattaggtatgtagttcagtcttaacgatttggcttttttggtgcctgtctttctatagagggacttccagaaattctaagcagactgaccattgaattctttgaacctgtgaccactgcagctttctcagcatgagaggagactccaagcccaggcttgtggcaagtctcatgataactctgtgtttagcatagctctctgagccagattgtcatggagaatatccaaggagattattggggctacatgtgaatattggccaggaacctgtatccacaaggctgtcctggtggcccagatgggctggtttcccagcagacttctctgcacagatgggatagcccctgacagaagttaaaggggctgaagttgatcctggggtgccttggcatctactatgggaaggaggaaggtgggtgtgtgtcattggctcatatgggtgtgaatcacccagcaagtccctgcacaagcaggatagttatttgattgcaaagtgaagacaactgaaattgatcaggggaaaaccatagaaaatatcatcaaaaacaaaaggtggttctttgaaaagattaacaaaattgaaaccaaagtggcagtagagaaggaatttaagcactacgtaagctgcatcccaaaggtttttgcatgttttattttattttagttaatttcaaagtatttctaatttcctttcttctgcttgtagtagaaagatttatattcctttgggtatatacccagtaatgggattactgagtcaaatggtaattctgttttaagttctttaataaatctctaaactgctttccacaatggctgaactaattcaccttcccacctggtgtgagaattcacattctcttctggctggtgtgagatggtatctcattatggttttgacttgcatttgtctaatgagtagtgatgttgagcttttttttcatatgcttggtggccatctgaatgtcatcttttgaaatgtatctgctcatgttctttgcccagtttttaatggggttgtttgtttcttgcttgttaatttgtttaagttccttatagattctggatattaggcctttgtcaaatgcatagtttacaattttttttttctcattctgtagattgtctgtttactctgttggtagtgtattttgctgtgtagaagctctttggtttaactaggtcccatttgtccatttttgttgttgttgcaattgtttctggcatcttcatcatgaaatctttgcacattcttatgtccagaatggtatttccttagttatctttcagagtttttatagttttagtttttacatttaaatctttaatctatcttacatttatttttatgtggtataaggaagggatctagtttcagtctttaacatatgactagccagttatccaagcaccatttattgaataaagagtcattttcccattgcttgtttttgtcagctttggtcaaagatcaaatggttataggtgtgtgcctttattttggggctttctgttctgtgccatttggtctgtgtgtctgtttttgtaccagaaccacactattttggttatggtagctttgtagtttagtttgaaatggagtaaattgatgcttctagctttgttctttttgcttagaatcaagttggctattcagtcacttttttggtttcatatgagtatttttttctgcttttgcgaagaatgtcatttgtagtttgattggaatagcactgatctataatttgctttgggtggtatggccattttaacagtactgattcttcctatccatgaacatgaaatgcttttccatttgtttgtgtcatctctaatttatttgagcagtgctttgtaattctcactgtggagctctttcacctcccttgttagctgtattcctaggcaaatacagtcacattttgagatatagggagctaaagcttcaagatatgaatttgtggagcaaagggggtacaatttaggccataatactttgtgtgactcaaatccttcaatattctttgaggcctaaagaaatgtatggcatgatctatctgtattctactcttttgagatgcagtgttctatggtttatagagtcattcaagtgttctcttttcttgttgatcttctgcctagttgttctattcaatattgaaatgtcaaactattaatgttaaattttctacttttctttttgtttcaagtattttgggactccattgtttagttcatatatttttacaattcttatgtcttcctaatggaaatatttgcatatacataatgagatatcttgggaatgggacccaagtttaaacagaaaatttatttatattttatatacaccttatacgcatatgctggaggtaaattcctatattttttataattgtgtactgaaatagtttgtctacattgcattatcagagagcaaatgtgtcagtatctcagccatccatgtagacaatctataattgttggtcattagtatcattcctgaatctgaatttatatgctactgataagtaatcattgtcttgcatttatgcacgtgtaagtatttgacagtaaaaaatatgactaacattaatatagtaaaaaacaatgtgtacatggtagctaagcagcacagtagcatcatcaaaatacctatgatatggtttggctttgtcccctaccaaatctcatcttgaattgtaatccccataatccccacatgttgtgggagggatttggtgggaaataattgaatcatgggggcagtttccccatgctgttctcatgatagtgagtaagttctcataagatctgatcattttataatcatctggcatttcccctgctggcacttattctctctcctgcctccctgagaagaggtgccttctgccatgcttgtaagtttcctgaggcctccccagccatgtagaactgtgagtcaattaaacctcttttctttacaaactacccagtctttggtgtttcttcatggtgtgagaatggactaataaaacctgtatcagccattaaacaacagcaacaacaaacaattgcaggcttcatctccatctacaatgctgtgttttgattatatcgttttttggtgagaagaaatagaagtagttgagggaccaggaagtgggtcccctaagattgaggaggcattcttctggatttttaaacatttccttgagatttatctgcctcattaacaatggcttttgtcttagaagtgtctttgattttgtatactgacatgatttcctgtactgttatgaatgcatgctgtccttcagtaagcccatcaaacattcttactatgttgtaactgcctgacagattcatcttgctgtccaaatagggttaacttacaagacagggaattacaatagagaaagagtttaataaagctggttaaacagaagacaagagagtttaaagcgttggctaaacagaagactgagaaatcaacttcttcaaatatttggaggctaggactttttaaagaaatttctttaggtgggtggctaaagaatgggtgctgctgattggttggggaggcaattggagcagtatggaaaatggcccttctgctctgagtcctcttctgcataggtgctacaggattggttgagtattgagtcccaggtccaggtggagtcatcagttgtcagaaatccaaaagtctgaaaagacatctaaaacagccaatcttaggttctacaatagtgatgttgtttacaggagtagttgtggaagttacaaatcttgtgacctttgagacaatgtctagtaattgtttagctatacctatgtcttagcagaattcaggtccctcttataaacttagtattgtggccttttattagctttataaaggtggcttatttttgagaagggctattatcatttaaattataaactaaatttctcccacagttagcttggcccacacccaggaatgaccaagagcagtttgaaggttaaagggaagatggagttggttaggtcaaatctctcactgtcataattttctcacttttataaattttacaaaggtggtttcaatgttatgtacaagcactttttctgcagtgttagcaatgtcatctttattgtcatgtcagctctcaaaaagtttcagattttggaacacttcagattttgtgttttttgcattagggatgctcaacctgtcctaataagtttggattaatgtctgccattttgctatttgttttctgtatgtcttacattgttttctgttctcatattcctatattaccacctttttgtgttaagtagatatattctagtatacaacttttattctttgttgtttcttttactattttaaggttttttttttttttgagacagagtctcactcttattttccatgctggagtgcagtggtgcgatctcagctcactgcaacatctgcctccccacttcaagcaattttcctgcctcagcctcctgagtagctgcgattataggcacgcaccaccacacctggctaatttttgtattttcagtagagatggggtttcgccattttggccagactggtcttgaactcctgacctcaggtaatcctcccgtctctgcctcccaatatgctgggattacagacatgaaccactgcacccagccttaaggttaatttttaagggttacttcaggaattataattaagaataatctcgagaccagtctggccaatgtggcgaaaccccatttctattaaaaatacaaaattaggcatggtggtggatgtccgtaatcccagctacttgagaggctgaggcaggagaatcgcttgaacccaggaggcagaggttgcagtgagctgagatcatgccattgcactctagcctgggcaacaacagtgaactttactctgtctcaaaaaaaaaaaaaaaaaaaaatcatggtctgcagtattaatttaatagcaaattaatttaaaagtatacaaacactcgtcttcaatatatatagtgttcctccctctctcttgcataattgccatccaaattatatcatttttcattataaggtatcaatagttttataaatattactttataaagttgcttttaaattacagaagaaaaagaattaccaaaaaatacatttatattattttttctatttatgtagttacctttaccaatgtttatcattttttgtggtggtctgagttactcttcagtgtccttttatttcagttgaaggatctcctttagtattttttatatagaagatcgattagtaataaagtttttcagtttttaatcttaatttctcctttgcttttaataataattttgaaggatataatatctttggttgacagtctttttctttcagtactttaagtatgttatcacactgccttccaactactgtggtttctgtttggaagttagctgttaattttattaagaatcccttgtgtgtgatgagttgttcctcactgcatttaagattctttgtctttatgtttcaacagttgaactgtgatgtcctaaaatataaatctctttagaagtatcctaattggatgtattgagcttattgcacgtgtagattaatgtttctcataaaattggaagaatttgttgatattgtaatttcttcaaatatactttctctttctgtgatttccatcatatttttaaggatgtgtttatttttctctctctattcatcagactggataatcctaaattgacctgtcttgaagttcattgattcatttgtcagttcaaatctgttgttgggcttctctatgatatcttttatttcagtaattgtactcctcaaatttggttgtttttaataattgatctgttgtttctaatattctttggtgagacattgttctcatactttaattctttagacatagtttcctttagttctttcaacatgtttataataactgcgttataaattcaacaactggactttatcagggccagtttcccttgcctgcttttcatcctgtgtatgggtcatattttcttatttctttgtgtgtctccctctttccagtctttttattattgctggtggttgttgctgctggctgctgcctctgtttgtttggtgatattcccataataattgtacaaagtctgtatcctttattacgtgtggccactaaagtctctgctagattagtttagtggtaagctaatgtttggacagagatttccataaaggccttgggccaaaaagtcttccagactttgccagagattatgttcgtgtgtggcgtcccttccatctttcatcaaggagtttacaactctggcatagcatttacttcctgcttgtatatatcctcaaggtcagctagacataaaagaggaggcccttttcctcatgtctcattaggtcatgtccagagttctacacatgtgtatgcccttctagatttctaggaataggtcagaggttttcaaagtgctgtctgaacatctcattcccctgattttccttttgacacttttaaagtcttgttaccttaattgccatctgctcaaaccccctcttcccaggtcggtcaactgcaaaattaaatagttgctatcatttgttttttgactaatgtcctagacatagggctattcacacagagtaaaatctacatcagattaatttaagacaagccctgagaatagagctttttcagggaactgtcagataggacaaatagtgacagtctggagatggggcatttgcagagcttcagacttattgtgccccctccagtggttgctaggttgctggttttcacagctgctgtaattgcaaggctactggttttccaggttaccaaagaacaggggagaaaggaatgtttaaattaaaacatcacaaagcatgttgttcttaatgagatccagccacttttcttgaataaacactctttggatttttccaaaattttagataattcctagggttcacaaaaacttaattttgacatttttggcaagtgcacttgttggttttatggaagactgattttcttttaagttcttattctgctgttttagaagtgcatccctcctattcaattttttagtaatatattttttctccacgaaaatttccaatacttttaaactatatgcaaatagtagttatagctgttttagagcttggatttgaaactattatctcgagtgcctatgatctgttttgtttgttacttcctcattggcccattttgttgtgttttgttttgctgccagtgttgtctttgctgaatcatttctacaaataagatatgttgagctgttggatgaaattattatgtctctccagagagcgcttaaactttattctgtaaagtgtttgtcactacaatctcatgtcacattatttcaattacggggattgaaatgattcaaaggtccattgcatcctctctctctctttctcttcccctctttatttttcagttctagtcaaagccagaggtttcagcagggactcttatgtgggcactgtactttaatccatgcccccttacctcgacaagactgttaagagcacttctcggagtctcatctaccccttctgaaatccacatcaaaactaggctcacctttctgggcctttgccttccctcagattctggcctgatcattcttcactattttattatctccctgattccttcaagcagataattttgatgtttcccagattttctaattgccttggttagaaacattatctgaattacttagtttaacattaccagatgcagaagccaactttatctttatttaaactcagtgtggtaaaatctagaattgcatcaatactaataaatagtgcactagaaagttagtttcatcagataccttttgttcttttttctggtcttttacaaaagaagaagcatccaaaaaactgtcagtatttttgtaatgaactcaacttacttaattggttgctttaaagaatacatttataaaatttggtcttaattctattgcagatataaatgaattttctttctctcttccttttttttttcctttgagacagagtttcactcttgtcgcccaggctggagtgcaatggcgtgatctcggctcactgcaacctccacctccttggttcaagcaattctcctgcctcagccacctgagtagctggggttacaggcacctgctaccacgcccagctaattttttgtatttttagtagagatggggtttcactatgttgaccaagttggtcttgaacacctgacctcaggcagcccaccagtctcggcctcccaaagtgctgggattacaggcgtgagccacggcacccggcccaatgtgttttctttctagctaacattaaaggcctgtgagaatgaatgcaaccaaattttttagaggaacttctctttgataatggtaatttgccaagggaagtcattaatctttttgtgtgtgacttgagaatattttttactttatcctctaatttctagtcattgttaatcctgatttacttcacggcattgaaagatgctaaggaaaaataaattctctcccctcttctttttttactgtaatattctttagggtccttgaataagagatattttgcagcactgaaggctttgtgtaaaaattgcctacagtctagaagtaaagctctatggtgagttctgccatctgttacaagcgtttacaacaggagtgcatcttatatacaccaattttgacaggaactcatttttaatgggcaaatcaggttatcctcaaaggtattgaataggaaacacagtcatgtattcaatgacttgaattttccttcttaatttttcattgccctatcactattgcaatttgcattcatctctatgctaattgcttcattaatactttagaagttgggttttttttttttattctgcagttgttaggttacctaaggcagagtaaatttcaactttaatctcaataaaattattactgaaatgctaccacttgtactttttgtgcatttatatttggtacattctatactccttcaacaagactctgtgatgtacatatacttaggatactatagaaactattttctcagtttagaaggttttaatcattgtactcattttaattatcttttagtgttgttggggatcagaatgtgatgccccaaaatatgctttgacatggtcaactaaagagcaaactcaaggtctcttctcaaatccctccactcacccaccttcatctctcaatcctctgtctctctcaaagcccaggatgaggctgttctctgaagtttccttatctacctagaaagcagacctgccaaaaaggagcacagttactgttgatccctccctgaaatttcattaaccagaaaaaattaaaattactgagattgtaaaaatacactttaaaaaaattaaaactcatacattagcagaagacgttgaaaattaaacaccacacttagagtccaggtgaactttgtcccacaccatattctgttctccagtcccactcagttcccaaagagaattatttactgtcctttatctgagcactgggcctatttatgccctttaaaaactacttactacccttcaaaatgactacatttcaccccatctcttctttccttatataaaaagggtatataagcatctgtaccttgctgggttgtttggtagtcattctcctgcaattctcctgtttttatgcatgtcaataacacttgtgtaacttatttctctgttaatctatcaactcatttcaacagatttaaattcaaactttcagtggggaaggaaaattttcttcatccctacatgtatatgatataatagacattttagaatcaatatgcacagcagattaaaaaattgcttaatagaattattagtgttattataactaagcataatacaagaaaacaaatgtttacaagaaattaggagatatgaagttctgactttctttttgcattcagacttaatcccacaaaatgggattgataataaatttgtgaaattttattactaacgtgataaatatgttttaggtttaatattgcttgatggtagctctcttctttaatatttgcagcaggttagtatttaggaaaaaacattaaaattattgcgtagcaatttcagacatgctgatagtattctaatgaaaatgtaacctcagttctggacaaagatagaaaaaaatgaaagatattatagaatatttattacttgaattgatttatttaggctatatgttgataaaaatattgaatgccttattgacctagtaagtttgcgggtatttatagattcagaggactttgaaaattataatgtagattctcttgtgtttattttattttactcaagtacaatcaggagaaaagaaatgaattattttctgaggaatgcaagtccttttaattgtcagacccagagagatactaaaatgagaccgcagtcacatcctatgctccactttcagctatgtatcatttcttgaaactgcttgttattgccacacatagctataaattaacctaataatgccatatggggcactgcaacccaccacctatagattgacaacacatagcaaatcaccaataaatgttatttctgtaaatcagcaagaatttcttacaactttgtatcatcccactccctgtctcgccacccctcttttttgttttttttttgtttgtttttgtttttgtttgtttgttttcgcctttaaaaatacacgtgtaactgctgttaattggagtgtatattcagggcaacttgaatctatccttctgggttggaatccccaagcttggcccaaatgaactctacttatattaattttgcctcagtttcttccttttaggctgacatatctggcataagtcagcaggattaagagtgactctgtctgactacccagtgtttctgaaagtggtgcttggtagcagcacaaacatttcgtatttggaattcccatctggcatgctgggtgaattctcctaccactttttggttgaagttgtagaatttatttggctgtttttcagacccactctttcctttaagagtgagtgctgtagtctctgtctttgggtagaacagggtgaagagctctgcagagagctgccttttttctacctctgtctcggggtggggttcaggtcaaagttttttccactgttgtctctcagtggaggcttgggtcacagaattgacagttaggcactagtggtctcattttacataggatactttaaaaatgcatctgcttttgtatttttgaaattaaggcttgatttttcatttgtgaccaactcctattagttaaacaccagctggttttatgtataacacttatggcagctcttatatatacctcagagtgtggacacatctaacctgggatggtcataaacacaatgacaaaaaatggaaattttaaaaatacctaaaataacttatttgcatgcacaattagaaaaagctagttttagaaccaaataggagacttacttccaatggtacctaaaatgcttctagaagaaattctgagaaatttgcctccattcaggatttaaagatatctatcaccaccacctgaggaaattccccaggtctttgacccctctccctgaaattcctattgtggcattcctagagacactatgaattcttctggttctgagggccacctgattctcaaactgttctttgctcaagtaaaaagaccactcaatgaataagacgaaactctaaaacatacctttgttcctagctgacaattgcttagggcaataaaacaggtaattaaaagattaatagtcaaaatggggaaatgagtaaaaataaagccactgagattataaaaatgcatatccaacaactttttttccaatcaggactaatgactgatactgatgttcaaatgccaacatccagggaattagctaagcagcattccagctaagatcggatctgaaaaaagttaaaatcctttgtaaactcaaactacctgctttagctttcctgtgggattaacaatgaaggctgcctccacattgtagttgagtagttaaaattctgtgctttcatcaccatggacccgggttcagttcctggtcagggaatcagtctctcttgatttgacatttacaccactttcgacttttaggggtgcttatttgtttttgatccttttcccttccacggacagcttttgatttcctgtctcctttcattcatcgggggcacatgaggcttttgggcttttatgtgtagatggtcagctcaaaagctgagaccctaaaaaatacggccagacagagatatggattatgcttcatctgtggctagcaaaacattcctttctttgtgctgtctttgagatagttctggattccatgtgcactgctttccacctctttgaagacaccatgtatattcttggttaagctgcaaccttggttaagtcttattagtttcacttgggaatgtacttcagctaaaaaagattcaaaatcctgaaatatcgactgtcccagctaaaatctgataataagaaatttaaaaggatgtttttaagagctgtatacttaaatgtgaacttaattaaaactgatatttaggatatatatgtatacatacatatataaacacctatacatataaacacacatatataaccatatgtattcatacatatatatctttttaagggctctgttctccttctgtaaaaacttatcagtctactgaatttatctgttcttaaaaccatgataaccatatgtgccccttctgtctgtttcttcatttacttctgtcagtccctccttcctcttaccacccttgatgccacgtaagggaacctaaaaaactttctaacagcctgggatcccttaaggaaatcagaaaaggttccagagactcctctttttgggagaaacctctgtttttcctcataaaaccccaagaattgttaactgggcagattcctcaagtctaaggttatattctcttttgcattaagctcttttgcatttggcttttagatacatacacaagtacatgtatatgttatatgttgtgtctacatatatatatatgtctgtacatgtttatatgtagacaatatatattgtctacacgttagcaaattaacttaaaggtgaatcctcataaattacataactagcccaaatacttttcaaattcttataactttagtaatttttggtaaataaaaaaatagttttaaaatagttggtaaaataaagacatcttcaaatttttagacatttttgcctgagtctgctggtcagacacatttaggctgtttctaaactattttaaaatcataaaactattgcttctgcggtacttttcatatttgcttaagttgtgacttaaacctgtaaatgctgactattggggtcctccaaagccttatacacatcttactataagcttgtcttcagttttaagccccaaattctggggtctagacaagtaaacatagtgaagactgggaacaacacctgggccccatccttcctggcccagctatgcttcttggccatgctagatgatattagatctttcaggcattgtctttacagctctgttctttgtgttggatactgcatctcgtacatgattaaaatttaaaattgcttactttctaaatttttcactaaaaataagggctactaagagttaaaattataattagtatatgcaattaaaactgttggatatgagaaacatgtctatatacagagcatataaagttaagaagtagagaaagtttaaaagagagaaatttttcctttatgtgggagagaactttatgtattcaaaataaggggaaaaggaaaggaaatttttgttctaagttaaagtgatagatgaaaactgaaggtttaaggaagttgtagaaggtttatgtaagaccgatttttttgaatggaattttgtgtgtgatcaggttggctaaaattaaaagggggttattttaatttaaaataagttaaaactgagcattaacatcaaaagtacactgatgcagggccagatcctgggcctctgtgtcagaataaaaaggatctgctttttaatagaaattgcaagagtttataaaaggtttatggaaatcttatcagtatggtcaaagctgattgagattggatagatttgtttgtaagattttattaaaattagctttagcattgataatatagtgacacaaatctaacttggttttccacataatattcatgagataataaaagattttttatttccttttgagtaagttgcataaaaaaagagaaaggagtaaaagattttgtttgccttacagtgtcaatattaggtattatgataattggagaaagcgcatcttccctttctcaaatagtaaagctttttgcttttaaaaatttttgaattatcactttggctaaatgaatcatcagtattttacagtgacctgtgatcatattttcagcaagtattttaaacctttgatatttgacaaattttctaaagtcaaatttcaattctaaattttgtccttttgaccgcaagctaactttttggacatttagggcctctggaagtccaagagagacatattaggcttatttgatatgaaatattgtaaaacatgaagttatttttaactattttggggttatatttgtataaatgtgttactaatatatgttccaaaattatatgagattttgaaaatttttatgattatgatgttaaattgttgtaggtaacagaaacaaccaatttttcttgtcaattgtgtctttaaccatggctattctaacactattgtcatccacaattattagtttactttgatttttggcaaaaagtgatttataatctgctacagtttaaaatttgctccttatgtaaaagcatttatggaaaagactctagcaaatgctcttcagtaggggtttctgataattttggagatcataccaatgaggtaggtagaaaaactgtaggactctaataaaaaacagctgatacgttcaaaaggattcttaacatcaggcagaacaggaattaattacatgggactaaactaacaattttggacttaaatacttctgtatgacttttggttgaaatactgttggttctttttatgttttgttttccagggtcaagaaaacattttttttttctttttgagccatttatagcttatagcaattgagtaaagcatacttttgtgagtaaaactgaaacatttgcccttctctaccagattcttcatgatttgaaaactattcgtgtatattcttaatttatggcaatatgatcatttgcataagttcaataaaaatctgttttcttttgtcacaggccacagttagataactggttattttaacccagattttgactgggatggcataattttggatgtgaccagaatgctttgatgaattaaaattgactttgcagagctgacaaaaagccccttggaaacactgggctcgtaccttgtgtaataatacatagttcttttacaaggtttctatccttgtggtaagtaaagaatgtcactttctgacaggcctaggaacctcaagttattttgggacctagagaagaattctcccaatttttatgattattgtagacagtctcatggcaaatctttggtttgaatagcctcaaggcttttaaaagtggaattggatgttccttatgtaaaaatcctagcaaagccaatttaaaggggattatatggccattcactattcttgttgcacttaatgcaaataatcaggccaagtataagaggactaaaccttacattgcaaataaatctgtcctactaagatttatctttggaaaaaatagagagctcaaggaagaaaacattgtatttcagaagaaaactagtacacctgttgttagagtctagtcttttccattgtttttgagctttattatttacctacatttggacttaatcctgacttacttcagtgctacgagacatctctaaagaagaatatggatttaattttcttcatgatgtttttagttgactccctaacagagtattttttccctattctgacatacaaagtctcttttgattgtaatcattgtttgcattatatttctgctatttaacttattaatgctatttatgtctcattgttttacttctaaaaaaactaaattcatggtactttgaagaccaggtaagatttagcaaatgacagcaaccatagatcaattactttgacaggactacctgggaatgagatttactggcagtaagggacacttggcagtcaaattttgatcactagtgtttttcataaaaaagatttttgatcaaaaaggggaaattagtaaagaacataactttcgtctgatgaatgcaaatcttttaaaatatcaggcccagagagatattaaagtgagacagtgatcacatcctgctccctggtttgagctctgtattcatttcctgaaactgcttgctattgtcacaggtagctataaattaacctaatccacacaggatactgttactcacgttctatagcttaacaatatctggccaatcactaatcaatgtgatttttgtcaaccagtgaaagtcctgacaaacaactttgtatcaactcactccctgttgcctcttttttgcctttaaaactttactcgtaactgctactaattggagtgtgtattcagggaaatttgaatctgtgctcttgggttggaatcctcaagcttggcccaataaactctctaattacattaaccttgtctcagcttgtttcctttgggttaacaataccatatatttaccacgtaagttttccaatgcctaaagaaaaattgtacctcactatagattttaaaatattataattaaaatattttgtccttttattttgtagtagaagaaaaataatttttcctctatccttctatgttcttgaatggggaccctatgacaaaagacagattacaagagaaaaatagagatttattaacatgtacatctcatatatacatagaaaatacgcagggaaatgagtaaccaaaagaagcttagaattcaggcttaaatataatcttcagctaaaaacaaataagcaaaaagggtgtgagacatgagttaaggaaaggcaactaggaaaagtatggtaaatatgaataaggtttgttatgcagatttaagttggagatttcctttataaatgtaaattttcctttcaaagagtagcttctctgttttcagagcttctatttctcaaaataatcagctcaaaataatcgttatactaaagaagcatattttggggcattatattctggtcttctgcagtcacatttgggggtggtaccttctgtctcctacatcctgaaaaaatagaataaagttcttaaatacattagagtccattctaatttgattattttaattagctttttattaagaaacaatttgatcttcagaacaacaccctgagctaagaaaagtaagtttatgattatttacactgtgtagattaagagatttaggcacagaaagattaagtgacttttttattaagggctggaatgagtattcatgtattccgaatactaatgcccttggtattatatacaaagggttggtgtaaaaaatcattataaaattttagtatgagtaatccttataataaaaaataaaataatagttttatatgtgcaaatattttgtctagtattaaatttaggatgtgcaggatgaaaagcacatgatgtaaagaagataaatgtatgtttgaatagatttaacatagtttcatgaactaaaatagtagtaaatagaatttctaaaatcaaggcatcataattatgctctagtaaatatatggcattataaaattccatatggttgactcattcattcattctttcatgacacaaatattcactgagtggctagtatatattaggtccttttttaagaattgagaatactagagtgagtgttaaaaagtcttagagaagcttgtctttcatcaaatttcatgaatactatataataatattaattatgagaagtactgactgcttaaattatgtgtactttcattttatgacttttttcaacataatataaatttgtattatgaacagtttcacagtagtaattacagctcctaaagtttaaaataaaacaaattgatattgactaaaaatgacagaaaaaacctgtcacaacaaaaagcaaacttgcaaataatctaaggggcgggtggtgatgagacagagaaattggaatgaaggtactttgtcagttctaattatcttaatttgaaaaagcaaataggcccaccagatgttactacataagttaattgtgtcttcaacataaaaggtaattaacttacatgcttacacttgtacaatttcttagactagagttaaattcacatgttatgactttccataacactgtcttcaaacaaaagtccctaatagagtaatataaagtctttgtaagtaggaatatccttatattctatctttgaggagactgcctaggccaggagttaagcatgctcagcatttgtggaagggagtgaggccctagaccttgacgtaatctgcttccttaggtggctgcttggccactcctcattgagggttcccttgatacatgcctcttgcttctccgctcctccagagccccatagagagaaggtaacctgaggcagtgaagctgtggctggattttcaccttagtgactgtaataagggcagctaacatttattgaatgcgaggaaattgtcatagtgctttatatgtatctaactagttcttactgcaaatcattaaggtaaattgtgtcaggatttggactttataggtgagcatcctgaggtacagggcagtcaaaaggtcaaaaactacctagtggtctgagatttgaaccccagcagtccagatcagaatctgtgtgtataacaaatcaggactgcagatctaaagtatttctatgatttagattttcctgttttcatgtttttctctttgacttttctaatattccttaacctcagttttttaatccattgatagaatttgaatatttgtcccctccaaatttcgtgttgaaatttgatccttgtgttggaggcagggcctactgggaggtgtctgagtcatcggtgtgggtccctcatgaatggcttggtgttcttctcacgcgattgagttctcactcttaattcttgcaagacctggttgttaaaaagagcctggcacctgctctccctctccgtttttcccctgccatgtgatatgccagcctctctttgccttctgccatttttggaagcttcctggagctctcatcagaagcagacactggcatcatgcttcttgtacagcttgcagaatcttgagccaaataaacctcttttctttacaaatttcccagcctcaggtattcctttatagcaatgcaacagactaagagattcattaaaaatgaaaaccgatctctgtcttacttccatcacagaattgacattggcaatacattataatctatgaaaaagtatttggcaacttaaaaacactatgtaagtgaaaaaaaattacgattatcacttgacactcttgacaacctttttattattattattatttaacacttttcttatggctttgtgacagtcatctcttcttgctttctaccagcttttctaaatgtccttcttctttttcaggcttcattgtcttttaacactcacagtaatgtgtaaaagccagggtcttaaacttgaacttggaaaattgagaaatcacttttttttttatcttatagataacaaaacaaagtttcagaagtaatctgatgccgtaaggttaattttgtcagagacttcactacacagtcttaagtcctttcactgcaaatgctaggtctattgaatgggaggcatttctgcatcttcttatttccgccttaaaagatatcagatctgaaagtaagtaactaaaattgcaagagaaaatgttttaagaccacttctgtataagactgcaaatggtaatatcagttaaaagcagaaaatggaaaagagtaaacaaattgattccataataaaacgatatgcagtagtggggcagagaaacaaaaacatccgtttttacatctttgggagagaaaagaaaactaactagcttgggactgattcagatagatgtcattttaaattactttttttcttctgtttaccaaaataatgtaattagatggagtaagtacaataaagaaaataggtttaaaacagatgtctggtaatagacattcacaccattaaaaactatatagggaactgcctgctaggcaaatgtatgcagaaccaagtgttgggtcattctcaagaaaaatgagccttgatggaagtgcgtagatttagccacagggtttttttcttttttttatattaataaaggatattgcttggtcaggctaggcagaatggtgtgttttgtgatttggtggggagaggtagatgatgaagggaattgactgggtaaatcagtacactgaaaaatgagaaaaggctgtgtttcatcttgtttttaatttaaaatcttttttatttgttttatgttgcttttcatttgtgttgtgaattcatatatatgtgtatatatgtatatatgtatacatgcatacatgtattatatataattcatatatatgtatacatgtatacatatattatatataattcatatataatatatgtatacatatagacatacatgtatatatgaatttatacatacacatattttcataagagagttaaatgataaacactgtatctaatttagtgatattttcattaaacttaactgatcctttgctcagggtttctttgaataagaagaaaggaaataattggaaggctaatctgagatggcagcaattgattttgaccaaagcatagagagattttaatttgaatggcagagtttccagagaaaagcaaagtgggccttcaaatgtattagctatgcaaggatctctgcgaaccttctaagtgacatatgtaacattttcttcataacctatacagaacaaatgttagaggaaattataatccttctgttactaagtactagtttttcttcccctggagacaataaattctccttaaatattcatcaatttatttgttaaaaatatcttctgtacatctactgtgcacaatgcatggggtaaatgttgaataaaattaacactgtcttgtatctctcagtttatgatcctttaagggatgtagatttatgattcagggtgatttgggctgtgtgataggaacatttactgtgctctgtgaacacttgtaggatccgctaatctagtctagtgtggggaatgagggcatatgttggaggctaaggaaaagatatgtggctacaacttgcaaagtatgaagagttggaagaatcagagtacaaactgcctgataaactatgctaagaattttgaaattcattcaatggacaatggaaaaccatcaaatggttttaatggagagagaaatgagtcaatttgcattttagaaatatgattattcaaattgatttgttagctaggattcttttcaggcaggatttatttcctctaattgttgacatagtcctttgtcaataaaggcttttaagatactgcaaaaaaggtaaggagaaatttgatgttgttcatttctgtttaacaattatcagacgatatctggcacgttcagagtggtatggccatagatggtttgataattatctataaaattccttgagaccattccagggctcttcctgttctgggagtgatacagttctgaggaagaccagtaaccctattttttgattcagaagattgtgtagccacttatctattggtcccttccaattgtttttcaatgaaccctgaatttccttacagaggtaacttggaattacctcgttggtctccctctctccttttcttcctaattctttaccaggctttaacctgatggtgactctgggtttcttcaagataattctgtttcatacagctatcttttgaattcatgtctgcaattcttggtttcctgaagtcatcactgacttgatagcatttagaagacatatttatttatttctaaacgtaactgattgctttttatggcatggctttgaaatattatcataccaaaagcagagcacgtggataagtggttttattttggagggaggggccctattcatggtgtaaataattccaccattgtcaattcactctaacaacttgacgttccttcagtggcctcttgcttcaagttgcaaaattacctcccatcctgaggacaggagtttacttttcatgcgtaaagccagttagcaaacacagatggcctaaaataccctactccaactcttaaaactctccagccatttgtatcagagcagttgatctcagactgaactctgatctttctacagtatggtaatagacttaagcaaagccttcccttggcagttgcaatttttgctttggcatctgttaagggttgaattttgtcccctcaaaattcatatgttcagattttaatcccccatcgcctccagaatgtgagtgtacttggagagagggcgtttaaggagatttctaagataaaatggggtcatatgggtgggccctatccaatatgatcaactggtgtccacacaagaagaggagatgaggacacacacagagaggaccatgcaaagacacagggagatgatggccatctacagccatggagaagggcctttgaagaaaccaacttggttgacaccttggtcttgagcttctattttccagaactgtgagaagataaagtttctgttgtttaatctacccattctgtggtactttgttaaggtaggcctagtaaacttacacaacaccctactggtaggacgagagacctgtcttatttcaatatcaccaatattcagtattaaaaattataaagtatttgccaatttagtaaagaaagagctatttttgattgttttaatttctacttatagtaaatagtagtaaagatttatatttcatgtatttattcatccattgtatttacacttttagaatttatcaacatctgacccattttcccattgtgaccttaatgttgttttaaaaaatctgttagaatgggacacaacggcatgtgcctgtagtcacagctttttaggagtctgaagcaggaggattactaagtccagagtttgagtctaacttgagcaaaatagtgagatcccccatctcaaaaaaataaatgacttagcaataaatcataaaaattagtctttagaaaaatctatttgagtggcccgttgaatttaaggactcagtgatttctcagtttgtctattttgttattttttaaaacacaggatattttttatttattttatgcttagaaacctgtcttgtagtatttttatgatttctaaaagttgttcagcactttaatccatctagaatttattctgttatactatgaaatatgaagacatatatcgattctttttctgacaactctttattttcctattagtgtttaccaagcaacacaatttcttatttggctggtgctttatttaccacatatgaaatgttatatttcaaaaatgtctattttgaagttatatcttgttttccatttatgtttatatgtgagtattattttgggaagaatagaggttattacaaataatttgttcccattgtgtaacatggtatttttttcttcatttatttgggtattctacatgcatttctataaagatgtatagtttgttacctttttaaaaagcatattccaaaccagccattacatactttgcttgtctttggttattatttttaatggttcccttcatcattaaataattcactgctgtgatacctgaaaacaccagtcatttagcaaatttattaattatataaatatttttaggtgattcttttctatttttattttctaagtaagagtttttgaaatttactgaaaatcatacaataaaacaatcagaagggtttatgggaaaaatagggttaggagcacagccctcaaaaactttgtcagtgacaatacaaaagctagaacctaataaaaaatggtagtatagttttgcatgtggtaaatggttaaaaatatatagacatactacaataaatatggcattttacatttaaaaaggcctaaaatttgcttgtacagtgagagtcggaagggttgcaactatgaattgttttgcagcagtggaaggagggttcaatgaagtagagagaaagttgtaacactgtatgtgggtaggggtgactcatagcacatactgtgaactgaggtggcgggtaggagtgcgtatgtgtgtgtgttattgtcttccaatgcttggtttagctacacacagttttctgaagtcactagtgtttcttgccaatgaaatcacatataagcaaaataaaaatttgcattatgttaaaattgttttctaatataccaattgtgtttgagcaaatttgctatttaaaacaagtgttatggaaaaactgaatctatttgaggaagctcaaatacctattctgggaaatcttttgaaattaattcttttataacttctattttttcccttcatttatttttccattttttatctgttgaggttatcttcttctgaaattctttttggtcatcccattgattttatctgcatttagagtgtacttctatttcccaggtctgatattagtctttgctttggctcactacccagctcaaatctttgtatatgagccaattgggaaaaatatgagggaaccaatagttcccaaaggacatttttaaatactttctacctcagttctctgttgtgcctaaagtcacctctcctttggaacaatttctttgccaaaaaggtacagtatagagtttgtacaagtagtgcttttctgtaaagcgtgaccatgacagtctgtaaaataataactcttctcttactgcccttaaaactgtgttgtgtaatataacaaaagtttttagaagagattccaactgtatggaagaaaagatgtattttctcacccattgctaggttcatggctgaggtacctatgacagacaacagattaacaagagaaaattatacacatgtatttaatataaattttatgtgacacaggagctttcagaaaatgaagacccaaagaaatagagaacctgtgttcttttacacttaggtttgatgaagagtggtcagtgctacatgctttggctatgcagtatagcctattgctcctaggctacaaatctgcatgacatgttactttgctgaaaccataggcgactgtaatgcaatggtaagtatttgtgtgtttaaacatatctaaacataaaatgaattcagggcaagatggccgactagatgcagccaggtggaacagctgccaccaagggaccgagatgactggcacagtcctaacagatattcagagggaaggcactgagagtagactgaggaagacacagaagctgggctgaagtgggaagaagctgggagccctacatgaggctgctacacactgggactcattcctggcccccagcaatgccagggaatggggagagttaaaatggcaaggagtgacctgctcttgccatggacctttggaatcccagcaggaggagacccctcaactgccagggccacttgagtggcagagagagctgcttagagaagtggtagaggcagcactgcagtcagtatggagccctgtgggtttggtgtgggaacatctgtaccagagtatggccagggatgcccatccccctaatttcaacttgttctcacgggagactttagccctaggggaactgtcagacctgacctctgctgggcagtcttgaccatctgatgagaccggtttgacttgagcatgtgttggtgtactagcctgtctcagggccccagcctggctgtgcctgcttgcagtacagcctcaggtgccctgggggcctgcatcatagctcctgctgtggcagatggtacctgaccagcagagagctccagcagagcagcacccacccagtccctcccttcactgcagcgtcccctgggcccatggccaacccccaatcactttaccgacatgtgtgtgtgcaggcaaatcttttcttccctaccacaccagcatgtttgtatgcatgaaccctgctctgccactgctgccatcatgagtgctctccgccccccatacccttgccatatcactgttacagttagggccttggcagtcacagaaccctacccctgtaccaacattgttgccagagtgaaactaggcacagagagcaacaaaccctcccccaccctgagcagccacctttacctgcatgaatgcacacagagggtagacacacacctgcacccaccagtgccctgccctcatgctaacaccaccaccagtgtgaccatgcacagagtcaccaatgggggcacctcttcctctgagacatgccgcctccatcactgctgtgaatacctgcatgaaagctgacaccccaacacctggtagcactctgttgcagctgatgagcatgcaccctgccatgcttctgctgcagctggcaaatgagaatgaggattgatctgctaccactggcctacaaaacacttcggctgacaccatccatcaaagtgtggtgactagtggtctggtagtatctcgatccccaccagcacagtgggttcctaaccttgaggagccagagagaagagtcaaggatcaatatcagtcccctagcgttagggcatgcagtccaggagttgtgagctgagctttgccccccaatatattccagaaatgaaggcagtcgactgaacccaccttatatctaccacaataaaactctcaaagtcatcaaatagggtaagagaaaaaacacaatgaaaccatcaaaggacagcaacttcaaagattgaaggaatatcagcctgcaaagatgagaaagaatcagctcaagatactaatctttgctttggctcagtacccagctcaaatctttgtatatcagccaattgggaaaaatatgagggagccaatagttcccaaaggacatttttaaataccttccacctcaattcgactcaaaaagccagagtatcttctttcctccaaactatcacactagctctctagcaagtgttctaaacttggctcatatgactgaaatgacagaaatagaattcagaatatggataggaatgaagataattgagatgcaagaatacattgaaactcaatccaaagaagctaataatcacaataaaatggtataggaacttaaagacaaaatagccagtataaaaaagaacatcattgacctgagagagctgaaaaacacactacaagaatttcataatgtaattgcaaatgttaatagcagaatagaccaagtggaggaatgaatttcagagcttgaagactgattttctgaaataacagtcagacaaaaatagagaaaaaaaatgaaaatctccaagaaatgtgggattaaataaagagaccaaatctatgactcattggtgctcctgaaaaagatgcggagaatgaaagcaactttgaaaacatgtttcagaatatcatcaatgagaccctccctaagctagctagagaggccagccttaaaattcaggaaatgcagagaataccagcaaggaacttcacgtgaagtgacacacaatcatcatattccccaaggtcaaaaatgaaacaaaaagacacaattatcatattccccaaggtcaaaatgaaagaaaaagtgttacaggcagctagagagaaaagctaggtcacccacaaagaaaagaccatcagactgacagcagacctctcagcattaaccccacaagccacaagagattggaggccaatactcaatattcttaaagaaaagaaatctaacccagaatttcatatatggacaaactaagcttcataagcaaaggagaaataagatccttttcagaaacggaaatactgagggaattctgaggttaccaccagacctgccttacaaagctcctgaaggaaccactaaatatggaaaggaaagaccattattagccactacaaaaacacacttaagtacacagaccagtgacactataaagcaaccacacaactctgcgtaacaaccagctaacatcacgatgacaggagcaaattcacatatctcaatactaaccttgaatgtaaataggctaaatgcccccaattaaaatgcacacagtgacaaactagataaataaccaagacccagtggtatgcggtcttcaagagaccaatctcacaggcagtgaaacccacaggctcaaaataaagggatggagaaaaatctaccaagcaaatgagaacagaaaaaagcaggggttgcaattctaatttcagacagtagactttaagctaacaaagaccaaaaatgacaaagaaggccactgcgtaaaggtaaaggattcaattcaataagatctgattatcctaaatatatatgcatgcaacacagaagaatccagatttaaaaagcaagttattggagactttcaaagagactcagacttcccccaaatgatagtgggcgacttccacactccactgacagtattaaacagaccattgagacagaaaattaataaagatatttaggacctgaattcatcactggaacaaatggaccttacagacatctacagaactcttcaccaccccaaaacagaatatacattcttctcattgccacatgacacattctctaacatcaaccacacaattgaacataaagcaatcctcagcaaatgcaaaagaactgaaatcataaccactctctcagactatagcacaagaaaattagaaatcaagactaagaaaattactcaaaatcatacaattacatggaaattaaataacctgctcctgaatgaccttggatgaataatgaaattaagggagaaatcaaaaagttctttgaaactaatgagaacaaagatacaacacaccagaatctctgggacacagctgagggagtgttaagagggaaatttagtgcactgaatgcccatatcagaaagttagaaagatatcaaattatcaacctaatatcatactaaaagaactggacaaccaagagcaaatcaacctcacagcttgcagaagacaagaaataaccaaaatcagagctgaactgaaggagactgagacatgaaaaagcattcaaaggatcaatgaatccaggatttttttttatttttaataaggcaggacaatcacttgaacctgggagatggaggttgcaatgagccaagatcatgccattgtacaccagcctgggcgataagagtgaaactctatctcaaaaaaaaaaaaataaaaataaataaataaataaataaataaataaataaataaataaataaataaaatagactagtagctagactaataaagaagaaaagagaagatccaaataaatacaattagaaatgacaaagcagatattaccaccaaccctgcagaaatacaaataacaggtaatattatgaacacttctatgcacacaaactagaacatctagaacatctagaagaaatgaataaattcctcgacagataatatctgtccaggaattttcaagactgagctagggaaaaatggaatccctggacagaccaataacaagctccaaattgaatcagtaatcaatagcctaccaacaaaaatcagtccaggaccagacggattcacagctaaattctatgagatgtacaatgaagagctggtactattcctactggtactattcctactgaaactcttccaacaaaagtgaggaggagggactcctccctaactcattctgtgtggccagaattattctgatacccaagcctggcggagacacgaaaacaacaacaaaagtttaggtcaatatccttagtgaacactgatgcaaaaatcctcaacaaaatactggccaactgaatccagcagcacgtcaaaaagctcatccaccacaatcaagtagacttatctctgggatacaaggttggtccaacatatgcaaatcaataaatgttattcatcacataaacaaaactaaagacaaaacccacataactatctcaatagatgcagaaaaggctttgataaaattcaaaatctcttcttgaaaaaaactatcaatgaactaggtactgaaggtacatacctcaaaataataacagccatctatgacaaacccacaaccaacattatattgaatgggcaaaaattggaagcattcccattcccttgaatactggcacaagacaaggatgccctctcttaccgttcctattccacatggtattggaagtcctggccagagcaatcaggcaagagaaagaaataaagtgcatccgaataggaagataggaaatcaaactttccgtatttgcccataacatgattctatgtctagaagaccccatagtcttagccctaaagctccttaagctaataaacaatttcagtgaggtttcaggatacaaaatcaatgtacgaaaaccactagtattcctatacaccaacatcagtcaaactgagaaccaaatcaagaatgcaatcccattcacaatagccacaaaaatactaaaatacctaggaatacagggagttgaaagatttctaactagggagttgaaaggtctctatagtaagaattacaaaacattgctcaatgaaatcagagatgatacaagcaaatggaaaaacatttcatgctcgtagataggaagaatcaatatagttaaaattggctgtacttcccaaaccatttttcacattcagtgctatccctttcagacttcaatgatattcttcacagagagaaaaacactactttaaaatccacatggaaccaaaaagagcctgaatagtcaaggcaatccaaagcaaaaagaacgaagccagaggcatcatgttacctgacttcaaactatactacagggctacagtaatcaaaacagcatggcactggtactaaaacagacacatagaccaatgaaacagaaaaagagagcccagaaataaggcctcacacttatgaccatttgatctttgagaaaaataacaaaaactagcaatgggtaaaggactctctattcaataaatggggctgggataactggctagctatatgcagaagattgaaattggaccccttccttataccatatataaaaatcaacatggattaaacacttaaatgtaaaaaacaaaactatgaatatgctggaagacaacctatacaataccattctggacttaggcatgggcaaagatttcatgatgaacacactaaaagcaattgcaacaaaaggaaaaaattaacaaacggactctaattaaactaaagagctttcacatagtataagaaactgtcatcaaagtaaacagacaacctacgtaataggaggaaatatttgcaaactatgtttctgacaaaggtctaatatccagaatctataaagaacatacacaaatttgtaagaaaaaaaatgaccccatcaaaaagcgggcaaaggacatgaacagacgcttttcgaaagaagacatacatgcagccaacaattatatgaaaaaaagctcagtatcactgatcattagagaaatgcaaatcaaaaccataatgagataccatttcacactagcagaatagctattactaaaaagtcaaaaaataacgtgctggcaaagtcacagagaaaaagaaatgcttatacatcgttgttgggagtgtgaattagtttaaccattgtggaaagcagtgtggcaatttctgaaagacctgaaaatagaactaccattcaacctagcaatcccattattgggtgtatacccaaaggcatataaattgttctaccataaagacacatgcacacatatgttcacagcagcactattcacaatagcaaaggcatggaatcaacctaaatgctcatcaatagtagattggtacatatacaccctataacaccatgcagccatttgaaagaatgagattgtatcctctggagaaacatggatggagccggaagccattatcctaagtgaactaacacaggaatggaaaatcagataccgcatgttagcacttttaagtgagaactaaaagaggagaacacatgaacacataaaggagaacaacagacattggggcatggtggagggtagagggtgggaggagagagaggattaggaaaaataactaatgggtactatgcttaatacctgagtgatgaaataatctgtacaacaaaccccatgtcattagtttatctatataacaaacctgcacatgtacccctgaacttaaaaaacataaaaggtacagtaaaattatggtattattatgagaccaccatcgtttatgaagtctgttgttgaccataatgtcattatttgttgcctgactgtactttagacctaacacatctatcagttaatgataaagttcattctcttatagtattccagagaaaacaaaatacattctcttcaatgacatagaaagacctcctatgaaaaagtagacttctggtgtcctcatttcaaaaggaggggttgggaaagggaggaagggaataagggagggagggagagagagagacggcggggcgggggaggaaaagagagagagattgagtcaaaagaggcttgcttgttcttacaagccacagtgcacttgctaatgagatcaagaattgaacatgttctaaaagtacctatatagtatacacatataattccttcaaagtcattctaacatggatatgactgggtctgagtactcttcttaattgctacttttccatagtttataaacataatttctctatgtcatgttttaatttggcctttttgtgggccagaactgtgaaactggatggagttaaaagcaacttgcagaatgttgtcatgaaatcatgttatttctaacattattaatgaatcttcacgctggtttctcaggcatagtaaaataatgaagcagagagaattaaatatctttgctttcttttcaaagtgtggcaatcattatttgtctaagttagtcattaggattgctgtgttttcattgaaaaaatagcagttagtgcaataatgtatcacattagtgcctaacaaaccaaagggatttagacactgtcatgagaaaaagcccatgggggttaaatacatactttcaactctaaagaaagtgcttttatatgaacagtgaaaagtctgctctttcccagcagatagtgcaaaagggaccatggaggatattaactgacacaaagctaaaaagtcaacctatacacacatatatgcatatatgtatatatacatattatttcatcactcaggtatgtgtatatatatgtgtacacacacatatatatatacatatatatatatcctattcttttattcatgtaaagaatgatttttactactaatgactactttcttggcatttgcatatttgttgattctaaactcaagacttttttattagtattgtggccatgggctattcatttaaccttttaagccttaatattttcatatctaagatgaagtttaaaatactttctctgtgtactataaaagaatgtgattatgaaatcaaataatgtaataaaagtattttataagctgagagaggcatcatacatatgctaggttatagtattacatatccatgtatagctgaaaggacttcagtatactctaatttttaaagtctgcatccaaatgtaatttatgaaatgaggagcctgtttgtatttgaaacctgcctttggacttctagtttgacgaaaatcagcctcccattatacgatcctctgaataacagccgtactgaataaagaaagtcttcattttgtcctatgggtcagaagctgtaggcccatgactccatattcatttcctgtcagtctccttgttaacaactccatgtaagccactctggccttcctgttcacaacaggttcattccacttccggaagggcttttagttgggatttccttatctgggaatgctctgccggattgttatttgacttactcttcccttacttacctctctaccaatatgccacccctttggagaagtcttctattgtcattcaatcaaaattttcctccctcattctacgcacattactgtctgtcctctggctgtcctttgtctttctcacagcacttatcattgcctgacattacacatatttatttgtttttattgacttttcttttggctttttaaaatcttctttataccagaagagtttttaggaggtagataattaaatatccttttccagtgtatttcacaatgctgaacagtgtatggcacaaaagatgcaccataagcattagaggaaagcaagaaaaaaatgaaagaaaaatggagggagggagggaggaaaaaagggagggaataaatggaagaatagaagggagggagaggaagagaagatgaagggaagggaaaggagaaaggaaggacagagaaagaaagagaagtaaagaaggacagatggccattgggtgccattgtttcctaacaggctaaaatattgcctcaatatttggaattaattttcagaacatttaaaacttaaatatgcactatgactttttggactgccttatattttgacttatttactcatatatctaaatgaatatagatttatgtatctaaatatatatgtgtgtatatagctatctgtctatatttatctattattcttgcctttctgtgtgcggttgatacttttcagtttactacattaaagccagttgggcatacagctgctgtatgttttcattgtaggtcaacagagaacagaatcttgtactgtggtaggcacttctccttccatagctatcaataatgggtgatttttatttttagctttgttgcttgtctacatatctttctgtgaaactagcgggcagcattattgtagctgaccatgaaagcagaatgtgatattgatgatattgtataatttaatgaagcagtgagattccatttctattaaatttactagatatattccactgcaagcacatttcattttcatggtgaactaataacttggctgcttatagatagataataaacattgctgtttatgtttgaaataattagcctggagaccatgttagtaattattgccatccagtgttcctatagctctgtgcttctctagagatacaggttctatttctggggatctatcaccggacttatctattatggtctaaaagcaataaatattaaatctttataatatatcctcatttacagaagctgggagctggatgaaagttgaaagtagtcctcttctgtaataaaccattggtctcaattatgggtagatccccttacctctcactgcatacagaaaatcacttccgagtattcactctgctttttatgtggcgtatgttagcatatcatgcatctcattttgtgcgccatgccttttttgccttaatgtttctttcaattgcctcattagagtaacaaacattttattttctagacatcttaacaatatcaaagatgctgttagttaacttgaaaattttaaaacaaaatcagtttcaaattttggttagctttctactattatactatgtaccttttgtttcttcagttttctggaaaacctagagtaaggtcacttgtggtaacttagttacatagttttattctaattatattggttcaaaattaaagtaatagccatcatcatataaaataactttttatattctttataattttaaatgtaaattgtgtatttctttaactgttagccttttattgaatgttatgatgtctataattctcacgtgatttttctaagaggaatattttctatgtgaatctctttacactagtagtaactagtaatgaatttttatttcaaaactttttaatttaccaagaaatatttgaaatatcaaatactttccacaggggttcattttgtggcatagttgaaaaatataattttatacatgaggatattaaaaaagtattcttgcagattcaagagtagatctaaatttaatatgctatttatcatggatattttactgaagtaaacaaacggaattatataataataaaatatagataactgacggaagtttcattttccccaaacctccattctgatttataagactatgtcattttaatattctttctatcgcttctcaaatatggtgtgctctatctgttttatctctgttctttatcccagaataacatttccgattgagagcaaaggcaatgaagtctatctatactagagcaaatttgtgggtccacagattcatcagcctgtcaaagactataatgactctacaaaatggaaaagcccctagtctcgagggcaaatagaattttatgtatgatttaggcatttacctacttaccggagtccagctgtatttagatagaatttcattttgtcatatgaactttttcagcatttagtcatccatataaaaactcaaatttataacattatttttcttgcagacaagaaagaagattgtatttagcttttcatttaaaatcattcattttaaacagctaatgattcttaacagcttgtcccattctgccaaaaatggcaatgagagagattatataatttctgtggtcatcaattgtgagtctttttcctgagtgcctgaaaataaagtagtaaaatgtgggttgtcaacagaatgacaatattaacaaatatataatttaagaaaccttagtataaagttgtaaaaaagcagtttaccactgataccaggcttctatttttggggatgggagttaattttaattgaattttatatatttttattctgcttacctgtgttgcaaaaatgtttgttcagccctttgtctttaagtttcagtggaagagaaacttcttctttattctaggtccctgttcccctttttcttaaagcatttactttagaaaatttgtaaatgtccattctttctctgctcctttaaggtattaatcttttaaaaagcttcttgccagttttaaagtccaagaatatctgtctcaggtacttggagccatctaaaataggggacctgtttctcagtttctgtaggagagtaggagcctaatttcagtgagtccttgctttaagatattaaattactccctattatgaagatgagaaaaaaattacattttctttgggtaaagcaaatcagtaaacatagattgtctaagatccccacacctcagctcttaaaaactttctagtcctttgtgttagtggagttgagctcaggctgagtatggcctttctttcctattgcagtagctttgaataaagtcctccttgcctatttaactttgtctattacaatttttgctttgatacaatgtaagctgttttatttccaaatactagtccttatcttcttctactaagattacagattttctcttaatgaacactcacttttaaaaaatattttgttgggccgggcatggtggctcatgcctataatctcagcactttgggaggtcaaggcaggtggatcacaggcagatcacctgcagtcaggagttcaagacctgcctggccaacatggtgaaaccccctctctactaaaaatataaaaattagacagtcgtggtggtgcatgtctgtaatcccagctactcgaggggctgaggcaggagaatcacttgaacccaggagatggaggttgcagtgagccaagatcgcacattgcactccagcctgggcaacagaatgagactctgtcttgaaaaataaaaataaagacattttattaattggcttccctatttcatattgataactgtgtctcctccttaaaattaagtcacagctgtgacttatattgtttctgatatgttcttcagttattttttttttttgagacggaatctcaccagtcatctcttaactgttggtgatctccatatattccatgcccattctctaactatatctttctttgattaattttaaatacatttcaacttccaagtatgtgtttatgattctgaaatatttcccaggccgtactcctcttgagttgctagactacatattttcctgctttttccacctcaatgcttcaagagtatctaagaaccttaatttatcttagaaccctattttacagctttttcaatattttcttactggatgagtgcacagctctcaacacgggtagccaagccaataacctggccattaacccacagcacatttattaacttatttttccagtacaaaggtcctagtaagttttgtggaataaaatagtacatgaataatattttataaaatcttggtggtttatacctgattttatatcttctctctgagtgatgagtagggagtgagagtgaggtgtagccagatgagtgtagtgtgaaaaatcaatccaaggaaggagaggctgattacttggtattgattagttgttttttgaaacattaagagtctagtttaaaatatgacaatgattagtttataaaaacaagtcaattttccttggaattgcattgaacctgtagattgctttgggcagtatcatcatccttgtcaaaataccaatattattcttcatagcattagaaaaaaattctaaaattcatatggagcaccacccctcaaaacaaaagccaaaatagagtaaccctgaacaaaaagaacaaagctagaggcatcacattacccaacttcaaaatatattacaaagttatagtaaccaaagtaaggatgctattgccataaaaacagactatagaccaatggatcagattacagagtttagaaataaatccaagtatttacagccaactgattttttgataaaggagccaagaacatacactgaaaaataacaccttcttcaataaatggtgctgagaaaattggatatccacatgcagaagaaggaaaccagatgcatatctctccttatatacaaaaattaactgaagatggactaaagacttaaatataaaaccaaaaactataaaactgccagaaagaaaaaaacaacataggagtaacgctgccaagacgatcgagctaggtaaaggtttcaaggctaagacctcaaaagcacagaaaactataacaaaaatagacaaattggattatattaaactagaagcttctacacagcaaagaaaacaatcaacagagtaaatagacaacctacagaatggcagaaaatatttacaaactactcagatgacaatggacgaatatccaggatatacaaggaactcaactcaatttaaaaaaatcccattaacatgttggctaaggacatgaatagatatttctccaaagaaggaatacaaatgaccaacagatatatgaacaaatgcccaatattactgatcattaggagaatgcatatgaaaatcacgatgaaatataccccagttagaatggtaattaccaaaaagacaaaacaaagaaaaacagatgctggtgtggatgtggaggaaaaagaactactatgcactgtcgatgggaatgtaaattagtacaaacaccatggaaagcagaatggagatttctcaaaagactagacatagaactatacaacccagtcatcccactactgggtatatatccaaaagaaatcagtgtatcaaagggatacctgaactggcatgtttgttgcaacactattcccagtagcagagatacagaatcaacctaagtgcctgtcaatggatgaatggataaagaaaatgtggtatacatgcacaatggaataccatttggccataaaaagaaaatgctgtgatttgcagaaatatgggtggaattggaggtcattatgttcagtgaaataaactaggcacagaaaggcagataccacatgttctcactcatatgtgggagctaaaaaaaagttgatctcactggttcgacttggtgtttgaaaaaacaaacaaacaaacaaacaaacaaacaaacaaaagttggtctcatagagaatagattgaaagataccagagggaagggtgtgtgggtgaaaggggaggggttagttagtgggtataaacatactggtagaataagccccaatatttgatagcagagtagagtgattacaattagcaacagtgtattatagatttcaaagcagctagaagagagaacttgaaatgttgccaacacatagaaatgacaaattcccaagatgatgcaatatcctgacatgatcatcacataccatatgcatgtaataaatactcacatgtactccatacatttgtaaaataatttgtattaattaaaaatagtttattaatggatgcagtgtattccatactagggtaaacattttctgtaaacaaccagatgataagtattttatactttgagggccaaaaggcaaaactgaggatattacttaggtccttatataataatttcagatacagttatataaaaatgttaaacatttaaatcccaccagtcatataaaaacagagaggagccaaatttgacttgcaggccatagtttgcaaacctgtgctctgtaacatattataaaaaaaagtttcatattcatgttgtaataagcctaaaacttaaaaaaaaataatccccaaatcatatgctatgtaaccctgtgtgtgtgtgtgtgtgtgtgtgtgtttagagttttttccttggacatagtaattttaatatcttgggcctaatttttattcttctcaatggcataatttcttggtagatgtaattgctaaaggattaagtaaattatttaattgcatttttattgcaattgcatgtggcaataattagatggaaatgagatgaatcatattcatttcttgtcatgaagagaaggtaatattaatctaactggtagatgctagaaaaatgttaatagttgcacttagcacataatctgcacttatttatgatgtgaatgtcatgcagaagagatataagtcatctgttaatttatttctagctgcaaagaattcagacttgcttaattttctgagttaatgggtctctattgtaaggataccttgaggagcaaaggagactgaaagttgtctcatcagcagtgcatgcaggactcaggaagagttgaagctttgcttattgtggttgaaaataagtcaacagctcttgcattctatcaacagttctggtgacccagtggggatttgagttctgccctgatatggctcgtttttgtcttctttccacctgtcctgcctgcttcttcctactctgcttttctctctgtactctgatcagtgttgcaacttcacacctcagagattttgcctaccttctttgtggtgaatgtgtgcatgacatttgttttgttttgttttaatttctaacctgggaaactcacaagtgatctctaatcaagaagatagattttctttccagatgctaaggacttcgggtctggtttgaatgtttgacctaatccctactttacagaccatgtgtgttgggttgtcaaagtttacgacctgaatcactgtcatttaaataccatgatagtcattacttcaaactgaaaggacatattatgacttgaatattgttactaccaagggaaaactaggtctagttttggggcttaaaagacgctcatagatttccctagaattttttttttcctttaccactgtttgttgcatgtctactatttagtcaaaaaccaaacaaacatagagggtgggcccataattcctgaccctgtgaattccacaattttattagatccattttatttttttgagtgactattaaacatggcttttgtccatttaataatagatcagttcaagcataccacatagtcggtccaatagtcccttggacataacgggaagatggctggactcaaggcaggtgtaaaaaaactaaatttagctgttttagctgttgtcagtatagcactgttcacctattggaataagaaggtaaattttattttattttattttatttatttatttttttaagatgtagtcttgcgctgttgcctggccgggatacagtacaatggcgcaatcttggatcttggctcactgcaacctctgcctcccaggttcacgcaattctcctgcctcagcttcccgagtagctgggattacaggcacacaccaccacgctcagttaattttttgtacttttagtagagatggggttttacaatgttggccaggctaggctcaaactcctgacctcataatccgcccccctcagcctccccaagtgctgggagtacaggtgtgagcccccacacccagtctaagttttcttatattatttaaagaacagaaggacattaaatgattgttgcatattcttaaatttataggtgacaccaaaaattaaggaattagaagattaagcaaaatgtagagataatagaaattactgcaaacaggagaaagcagtcacaatttagctcaaggtgatggagattttgaaggaatggtagcccacagttttcaagtcatttgatttttgtcaattttagctaaaaatccagaattaatacaaaatgatatgaaatatattttgtttacctactacccccagtttacctattgatgtctttgtccccattacctcagactgtgaccttatttggagacaagatctttacagaggaaatcaaattaaaataagtttattaaagtgggccctaatccaatatgactggtctctaaacctctttcttttgactgtctagtttccaaaactgtgaagcaataaatttctgttgtttaagttatacagcttgtggtacttctttgcagcagttgtagcaaactaatactcaaagtctccctgatttttaaaatactggcaacctgctgaattacaaaagaaaagttgaaaccaaacatatcttcctcctttcgggtctggtttgaatgtttgacctaatccctcctctccagaccatgtgtgttggattgtcaaagtttacgacctgaatcactgtcatttaaatacgatgatagtcattatttcaaactaaaagggcatattatgacttgaatattgttcctaccaagggaaaactaggtctggttttggggcttaaaagacgctcatagatttccctagaattattatttttttcttttaccaccggtacctttagattcagaattatacatcatttaaaaaattaccatcaaaagcaaaaggcaaggtacacttgttattctaggcattcagaatgataattgaacatttggggatatgtgtatgtgtttgggatttgtttcaatcactgctgcttggtattaaaccttgctaatgattgctaatccttcctgtatgtctcaaattcaatttaccaaaaagagaagattctgttggtggaaaagtcatcatagtgggtgaaacatttgtattttattaaagtttaattactttttaaaatcagaccatctcaatggcctgatgacaatctccagtccagcatttttagccaagggagggtatgatgaccagtcactgtgtgtaataactcaccattagttatgactataacatctaacctgactttcctagactactctgcacaataattcaattcactgataaatacaggaaagattcaggccaaatgagatatgttcacagttttaaaatctttattcattgaattattggagataaatgaaattaaaaaatctttatggttatttaagtcttatgacaactttgttcaacatcaacaatttatccaaatctggtgcaatagaataatcagaattattacagatagcaaacagaatgcttcaaagatattatttatcattcaaacataatataattccctattctatttgagttccaaattctttaacatcatagttttgttggttccattaattcaatatgaattgaagccaactgatccatgctgctagcaattttaaatatttcatattcacaaatgagcattccagttaaaataaccattttctgttgctattttaaactccaaactagatgttaaatcagtgtatgctataataataaaacttagaaatatataaatatgggtatattctatatggtaaggaattttctcactggaaaaattattttgataaggtataactaaatcagttagataaagcattatttcaaaagtatgcctcactttctcaaactgtgaggttaagaagttggactatatgaattataagggttattttaactctaagaaccaaaaagaagaaaaggaaagaaggaaagtgaaaggaaggaaagaaaacaacaaaaggagacagagatacagtgtttttccctctagttatttgaggtaggttttatttgatagttcgaaagacaatatgatgaaaaccaagaaagcaatattcatgtgaattccagtgttgtatttttttctttacggtatttttgttaatggaaaaaagatgattattgttgttgtagagacactgcccacggacttcaacatatacctcagaaaaccctgggatcaggacacagacgtgccatttgcaaaacaaaatctgactgtaactacaatttatatttgtttctaataaacggcatcatgaaatacatataaacaaactcatagcttagtcattgagaggtactttgaaaacaggagggaatgccatagagtttaatttgttttgaagatacttgtaactcagataacccacgaagaaaatgtggttttggggttaagaacatgtatattttagttgtaattagctacactggaaaaactctgactttaaaagaactatgcccctcaattgacctagagtttctgtaaatgtttgccacatccatggcattccatagagggtttatgctttgctggatgtaatccctggtaacagactcatggtttctcccagtgccagtagctgacgaccctaaataatatataaccccgaattctaagctatattttttccattaagtttgtaggacaaacatatatcagaacaaagagaaagtatggggtttagacagcatgatatattttttagttatccaagccatttgtgattgatacatgtccagcagctgtcttttaatataaaatacaatttaaaccttagaaagctattaaccaaagagccatgatttgcattaaatacagttattctattcagggacgtaaagtcacatttatagaatagacttgatcccttgtaaatgtaggttgtaaatatttggacatttaattaattaatgtgttttgcctaatttttataagctactgtgatgcacgttaccacagaatttttttctttaagtcattagttcgaaataaatatgaactctgttgtataatttctttcttctatttaccaactgtccttaacaactggattttagaaaattcaagccactcacacaattaggcaggttaaagccacaggaaacttaataataacctgagtgatgacaacattaaccagcagttatcagcatcaatggcattgagctatacccatggggaatccatttttccaaatgttacatagactatttaacactttcccagatgacaacagataaatgatgagtgacttttattgttatttactacatgtgtagagtatatatattcacatatatatatacacacacatatatatagacagaaactaaaaactcagttttcagtgattgtaattgcctatacatacatagtaaatatatatatatagacactgaaaacagttttatattaatattaataaatgtatttcatgtttagttaatgaagagctgatatcaactatacagatttctctttcaaatacataaagaattaattaaaaataacataaaactccagttacagtaattagttattgtgctttttattttataagttattgccaaatgcccaatttatttatgttatctttggctgctatgactcagacaataaagatgatgacagtattttctgggattaatatttatactttaaagggcaaatctctaatgtttccacagaataataaccttgagaacttataaaaatagagctagaaaccccatctgcagatgttctacacttttgtgggtctggctgaagtgccacgctagaagctgaccagtaacctccccttccccagtgtgaatctgctgaaaatgctccaggtgggggtcaaaatggggggatcatggaaaacattggaagtatcaacatttaatttaataaaataattaaatcattgatatatcatttcaaccactaatttaatagagatgtattaaatacttgtgatcagtagctcagtaaaggttctatatttctgcaatgtttctgttgtaagagaacaaagggtgtaacctccttatcttggattaaaacccagaggtagggtagatttacttaagacagagctagttatctccaaaccccaaaacgttactttagtgaataaatttctgattttatttcagacttcttagatatgaactacaaattctcgttttgcctccatagatatgtattaagactttgaatattaagttaagcgagtaattagctaactagagcttgaagatagcttgtttggctttggcctttagatatatttctctttactcttcattatacaaaaaggctccttcatccaggaaaatagacaagaaatatcagatatttgcttattataaagactcttcaatgttttgcattaaaacaccccaaaaccctaaattctcatatcaccttcttcattttgcttatctttttaaaattaaaagacattagcggtatggtctctatagagagactagaagattcaatgtgatgttttaaatatattagactagaataatattctgaagaacagagagggaagaactgggctatttttaaagcaaacaaaaaatacccaaaaactatacaaaggaaagaaagaaagaaaaccaaaaggaaaaagaaaagtctactaaattttgtacattttctagccatgctaaagaaaaagacaaattgtattaaatttttatttaataaaatccttaataatgccagtcacaaaaatgtatgtaaatacccatctgtcattttaagtgaggataaatcctttctttttacctgtgatattcaggaaattattttgcctcatctattgagggaagatctctcttaaaatattgtggattttgttcttcttgtgttaataatttcctggtttcagactagctgatttcttaataacaactttaacacattattccttatctgagcattagaaacaaaatatggatatgcagagacatggaactatccaacctattgcatttactaaggatgggaaagcactggagggagctaattgagtccatgctgagtaattatcaatggaaatgagtttggccattttcttttgcactgggaaatttaaacaaaattgttgagtagacattgatactgtatttgtgcattcattaaagtacaaaagcttctcattttaattcataggacatgaattagaagaaagaaaggattacacagaaataccatgcagcataaatgcattcatggggtggataaattttctttaagtagaaccagatttgcaaaggaatctccatatcctcaaagttcctcttcaaaggatttgaccatttttggatgagagaaccaatccttgaccgaacatgattagggatagcatcagttagtaatttcttaatgaacaacttatttgatggcataatgtatagattataattgccaattgattatttatcttatagacatgtagctgcaataatggtttacctttattttaactgcgctcttgttcttaaaaataacaattgctttttaaatctaaagccatagtattaaagttgcttttaaaaatgttgctgtccattagattcacattttttggatcataatattgtgtaagcataaatgcattcaatttaaaagctatctataattaaatgcatgttatattcttcctcttagaggaaaatacaggtactacctaaaacatggttatgcaaatagcactttctgagaaaacgccttggactacataaaaagaatatcatataaaatatacgtttagaataatgtattctaagcccaatgctgttttcaaaatgagggcactgcagaggtagcagcctctttctctgtgaatattccccagaggagaaacattttaatatttttgcactgaacaaggtgacttgaagttttttaaaactataaaaatattttgagggttaaggcatgggtgtgaaacttaggtaaagtagtggcatggctcgtcctttgattcttgcctttccaccatccagtggcctgggctctgctccaaacatgcttcccatgctagattttacctctgcttgtgctacttatccagtaccatatctagcctcattaagagccagggtgaagtatttcccagtgagaaaacatagcagacctgaaacttatttctggcaccatcacccctcaatgcaaatctggagatcaaggaatgggcctgagaatgactctacatggtttggttgacactaccccctctcaaatctctccttgtcttatcctaatttgagtatacattgggactgcatgccttggggaagtatattgatgctcttgataaatagggataaagaagtatcttatggtttaaggacaaatgtgagcagctacatgcttagttgggtggtaaaggaggcaaagggaagatgcagaatatttgctatactctagaatctttctatttcctagcattttgtaagattttttattaagacagaaactttttgtgtgtgtgtgagtctgttctttctctttatatttttcgaaataagcattctagtcacagatttggacaaaccagcccttggtcacagatattcatatacagaccagatagaagcattatcatttttctttgtcttttacatttttaatgtggattataaaattctagtcctaaattgcagctacgtaaattgtcactgtgtctcagtttaatttggctagcatgtatttgcttgtcagctaatttgccaagtactgtgatagactcaagtagaaaagtgtgatagaatcaagtagaaaagtctcgttttcatgacttttgtagtccaaaataccacaagtcctaagcaaccataatgaaaggaaatatatagtaaccattcccccaacatattgtgtactaggtgctgaaaacacaaaggtagaaaatatatatcccagtcctttggggccatgggaatgtgtactcaaaaacctaagatattagcctaactgccttgagacccaggtattcttataagctaaggattttaataaaatcttatacatagctttttttaaattctaagatcatctcctacttttcttcaggttatatttgtttgcatgtgtgcagtgatggtgataagaagatggtggatgattttactgcttttattttattcttatcaagaaaaataaaagtggacaaccccacatctgttccttaaacaaaacaaaaaatgtatacataatataaaatacatgtacatatttaaacaggaccttgaaagagggatagaacatggcccttgagagatgtcataaaatgggggaagcatattcctgatgaattgaatcacatgaacagtggtaaagaattggaaaagaacagggaatgattagacaataaatgaatctggctgaaaatctggcaggttgacaagaactatatatctaacagataatagataatttctgtaagttattatttgctatatgaaagggtatgtgccaagactttctatagatattagatcgtttaatgctcaccacaatattatatactaattattatggaaattgtactgttgaagaacttggggctcagaacttcattatagaccttgctctccacttcaattgcaattggccagaaaggtgaggggccaaatatggaaggacctggcacttttttattttgatagtgtgaatttattgaaaggctgatagtctgtttgcttttattctttgaaaggaaattaatatttaatttatctccaacctcacacactatgataaagccaagttactttagtgcatctaccatttgataatatgaatattatgattaatgcttaataatagcattttttggtttataaaagaatgccagataatgtctttttgggcaactcttctttctccaacctacttggaaatgccagagaggcttctcttctctagctgcagtatttcctacacgacatcattcaatttgatgttttaatatacaatataactgtatattgctctcaaatttatatttctaggcttaacctctcacctgaacttcattatatttaactggctcattgacatgttcacttgaatatctaagaagcacttcgtaccttggatagtccatatttttcaaattagattgcctgtcaatcatcattattaaacaagacactctgtttccactcagtttaaccgttctgttttaatatattaatttcctctccatacttatatctgtttctaggcctttcttcttttcctgtttctaagtcactatcctattttaattttgcaatagattcacagtttctggtttggaagacagccattctaagatgatcaagggcattgactcttgcccttgtatatttccctccatttaaattgtataaaacatgtgaagataaagagatattactccatggttatgttatcttacacagtatacgtgactttaagaaagggagattattccagatggacatagccttgtcacatgagctcattgaaagctgagagttttctccggcctgtggcgaaaaagagaaatttaagacataaagagtacttggaaaattatataatcatgtaggatactttggaagaagagaggatttaatggcagtaggaagaacagttaggaacttatttccaaagtcaagggcagagtaaaatggaaaaaaactatattttaagaagtaccataaaggtaaaactgacagaattttgaaagtaattgaagttgtaggtaggggtggatgaattcaagctgactttgaggttttaaatatagatgatatgtcattgttaattaacaaatacagggaaaagcttgggtcataggaaataggcagaagttagttaatttggatatgacttattgagtttataatcctggagaaaaatctaggtgaaagcaatttgactgttacaaataagaatctcatagtacagtcaaggatgaatcagtctgggaatttagagtcttgggttatttctaccctttcctttgccatggactagctgtttgatcttgaagaaacaggtgaactgtcctgagcttcagtttcctcatatactgagacaagacagtcaattgaattcaccagacatttattgagcctctaccacgtggaacatactgttctaggaattacagaaaataaaactgaagtgatctgaaaggcatcaaaaaaggactatgattaattttgctagatgaagacgagtggctgagtttaagagacacccagatgggcaggatcagaactcatgatccactgaaatggtcctgtgaaatggagatttacctcctaatgcaaaaattccaatacatttttctccagctctaaaaaaaaaaaatttaactgggttttatttcttaccggataaaatctaaactccgaagcattgagtacaagatcatttatgatctttcctgccttctttcccagatactgcttctactttctactctaaaatttgtacatgttatttcttttgtctagaatacttttcctcaccatgatgttgcttgcttaatgagtggctgtcaaaacttcaagaacttccctgacctccatggtattattcatctatgctcacgcatactcttttttttttttgtcttgaaatatgaccttcatttgttggagttaaaatattattattggttcaaatttcctttcctcattaggtagacattcttgaagacaaggttcatttcacactttaatgttttcataaaatattcagtttgagtgtgtccatcttggcattgactttaccagcagttctgagctcaaaccaggtcttcatcaaataactactaaataactcttgctgcagatagatccatgtcaattttctgaaatgctatccctctaaattctaaatacatttctaaattgaaacaatcactttctatttcaagtacagcagagaaagagcttatctaaaacaaaatttcacatagatatcaactaattcttttggaagctaaaggagattttaatcttttatctaaaaggcattttactctcatacctatataaatttttagaaaaaaatgcattcaattaattctataatcaaatgcccacttgtaagcctgcatcccaatttgtttcaatctcaatttaggaccttcctctgctagcacatttatagaactgggacatctgctactattggacactcaggcccatgtaagagccagctgcagcattcattatttatttgaacagcttgttgatttgtaagtctttaaaaattctcctgctaagcaccaatgtgagattttattttcttttatattttccttttttggacatatagaagtttctatgaacagggtctgagtaattaagctaacaggaagaaatctctgaaacaatgtcatccaccctatagtcatatataaattggataaagtgaaaagatagtattgtttcgtgctctgcaagatacttattaaagtatccaccttaaagatgaaaaaaccctgaatatttttacttccacaagtactcattagtatgtcagttagtgtaattgatacatacagaacatgcatgaccaagtggcaagcaaaattttgacaggtaaattttcacaatttgttattttctaattggttcctacaaatttcattacaaaagtgaaattattttaaaatcctagatattttaaatgttaaaattttaagaattaaatccaaaaatatttttgaaactgaatatattcttttatttcctaaaatggtcatgatggggttttttggttgccattaatgaggtacaaatgaaaaataaattgatgttcaaagtggattatatatatattcctcataatttttcagaatgttcaacaagggctaaaaaaaaagacatctgagaattttatctaaaacttcacacacacaataaaaatgaaaaagcactaaagaaatctttcagaatagtgtgttgtcatataaatgcctacttatttctaacacagtcacttttgttaattagctaaatgttattttctgaaataatctcttcgatggttgatttgtgtggatggcacacagcatatttctggttattttactagaatgagtaccacgtattttaaaccatgaatttccaattatatgtaaagaatgatatttattaacattaacactgtttaaacaatgctacagtattgtatagtcaaattagggattcatttttatctcattatgaaaataatacatgatcattataaaagatttagaaaatagagcctccatcaaggagaacacaaaaagagtcacatttttcccaaatagcatttacatactttttcctagcttcctgaaggtttaattgacaaataaaaattgtatatatttatggtgaaaaatgtgaagttttcctatatgtatacattgtttaataattaaatcaagatgattaacatatccatcacctcacgtacttctctttgttaaatgaaaacatttgggatctatgctcttagcaattttgaagtatatgatatattattattgattatagtcaccatgttgtacaatggatctccggaacctactctttctgtctggaagtttgtaccctttgaccagtatctcctcattccttgttctccttccttagcaagtgatttttataggttgatttcataatctgcacctttactgttattctaacagttttttttttggtgaaatcttaaatgatttctatatacaagattatgtcatctgcagttagacacaatttaacttcttcctttcctatttggatgccttttatttctttctcttgcttaattgctctggctaagacttctaatactatgttgaataggagtggtaagtgtgtgcatccttgccttgttcctgatcttagaagaaaaactttcaacctttaactattgagtacaatgttaactgtggtacatatatggcttttattatgttgagggacattccttttgtatctaaaatgttgacagtttttatgatgaaagaatgttgcctttcatcaaatgctttttctgcatcagttgaaatgatacagtttttgtccttcattctgttaatgtgatgtatctcatttttaatatgcatatgttgaaacattcttgcatcccataaatagatcccacttgatcatgatgattattcctttaaatatgctattaaattcggtttggtagtattttgttgagaattttacatttatgttcatcaggaatattgccctgcaattttctttccttgtagtgtccttatctggtgttagtatcagtttaatgctggactcataaaatgaatttggaagtagtctctgatctttaactgttttgttaaagtttgagcacaagttgtattcattcttctttaaatatttggtagaattcacctgtgaagtgaaagccagtatgctactgggctttaatttgataagatgtattttgttacttattcaatccccttactcattattggtctgctcatactttctatttctgcataattcagtcttggtaggttacatgttctaggaatttatccattcttctaggctatccaatttattggtatataattgttcatggtaatctctgataatcctttgtatttctgtacatagtagacaggatcatttataggtctcctctttcatttctgattttgtttatttgagtcttgttttctttctcttagtctagttacaggttgatcagttttgtttatgtgttcaaaaagcaacttttagtttcattgatctgttctattatttttccagtctgtattttatttatttttcctctcatctctgttattttctttccttgctaactgtgggcttagtttggttttcttctagttccttgggtgtaaattttttttatttgagagctttcttctttttgaacgtagtcatttattgctataaactaccctcttagaactgcctttgctgtaccctgtaagttttgggttgttgcattttcatgttcatttatctctacatagtttttaaaacttcctttttgatttcttcttgacccattggttgttcaggatcatgttgtttagtttctacgtacttgtgaattgtccaaaatgccttctgttatttatttctagttttataccatagtgtccagaaaagttacatgatatgatttctgtcttcttaatgtgttaagattcattttgtggcttaacatatgatctatcctggaaaatgttttgtatgcacctgagaagaatctttattatgctgctgttggatgcaaggcattgtatgtctgatctgttaggtccatttgatctaaagtatagctcaagtctgctgtttcctcattgactttctgtttgtattacctgtgtgttattcaaagtaggattttgaagtctcctactactgtggtattactatctatctctcccttcagatttattaatatttgctttatatatttaggtgctccaatgttgcatacatgtctatttataattattatttcttctaaattaattgacccctttgtcagtgtgtaataaccttcttttttttttttagttttttcactatttctattacctctattagtgacagctaatagaaatatagctctctctactctcacttgatttccatttgtatggaatgtcttttgccataccctcactcttagtccatgtgtgtccttacagatgaactgagacttttgtagacagcatatatttgagtcttgttttttgttttttttaattcattcggccactctgtttttgattggagattttaattcatttacattcagtataattattgctaagtaaggatttattcctgccattttgttaatttttcttggttgttttgtagaacttttctttttctctgttatctttctctgtggtttaatgagtttctataatggtattttcttcatcttttttgtatctgctataaggttttgctttgtgattattataaggcttacattaaacatcttatagttataataggctattttaagctgataacaacttaacttggattgtataaaaaacactacacttttacttccaccaccatatttgatgtttctgatgtcacaactcatatcttttttattgtgtcttaaattattatatagttatttttaataatttttaacctttatacttgaaatgttactaatttatacaccaccattacagtattatggtagtcttaatttgactatgtacttccatttctcagtgagtattatattttcatatgtttttatgttactaattagcatccttttgtttcaacttgaagaatttcctttggcatttcttataaggcaggtctagtggtgataaactcacttggcttttctgtctagtaaagtcttttcttcctttttgaatggcaattatgcctagtaaactatgcttatggggcagttttttgtttgttttttggttttcttacagaactttggctatatcatcaactctctctctggcctgcaaaatttttgctaagaactccacaggtagccttgtcacgtccccttgtgtgtgagaatactttttctcttgctgctctcaagattctctcttcatatttggtttttaacagtttgattttatgtcttgataaagttagactttttaggttgaatccgattggatacctgtgaacttcttatacctagatctttatatcattttatagatttggaaagctttaaacaattatttccttaaataaactttctgtcctcttcttgtactctttttcttcttgaatcctataatacaaatgttagctgtcttgatgttgtcccataaattttgtaagatttcttaattcctttttagtctcttttcctttttttcccctctgattaaatattttccaattacctgtcttcaagtttataggttctttcctctgcttgatcaattctgctactgacaattcctatttgcatttttcattgtattcattatattcttcatctacagaatttctgtgtggttcctttgtatgatttcagtttctcagttaaattttgttcatgtattattttctcgatttcgttgagttgtctctctgtgtgtccttatgatttgctgaggtttctttaaataattattttgaattacttctcagaaaatgtatagatctccatttttgtgtgtgtgtcagttactggaaagttactgttattttggtggtgttatgtttctttggtttttcatgattttttgttgccttgcattgatgtctgcaaatgtgatggagtaataatctcttctgtactttaagatttgttttcagtgggaaaagacattcccctaacgtcagatgagagggctccaactgggtggaaagtggtagttctggcttgaggtgaggttgcaacaatgtagtctctgtttagctctgtcagctaaggttggtgttggcaaagattgcagagatcctccgaggaggccaaggctgtggatatccttagtggtggcaagggctgtggggttgttcagtgacaaatgctgctccgtcctcttaatctatttttctccaaccagtgaagccatggccaagggcatccctctttgctgctggcccagcttccaggtgtgcttgtggtgaggtgggtacatacaacgtggctgatgctctagggtcaagggtttgcacagggtcgagagggttgagtgatctggtccctggggcagcataacattaactccatctggtggagagggcagtagcatctccctctcctagggtcaatggtgtggtttgttgtctcagtactgaaagatgctagtgtcctttgctgagaaggctactgtgcatgtcagctgtattcaccactgatatctcttgcacttcctccttcctaaccatttccacatctcaagtatgctggtctccccagcagtcctttctgtgtgaatattctcctttttttttttttttctccttactgtgttgccgcaagttcttaaagggatccttgagcccttccaagactattatcattcatggataaatatttttattgtcgggggtgcggggagaagaaggtttgtatctcctactcccttgctgatgtcactctgtagtacacatatctttaataatgtgatcatgtagtacatatgctattgaaaatttttttcagttaacatatattaaacgctttcccatgcaacttataacctcctgtgatatattattttttatgcatgcatgctatttaatcatgaagatgaactatagtttatataatgagatctctatatttgattgtttgtttatagatatttgctataataaataagtcagaagagaacatttaaaaaatatatattttttacatttcatgataaaatccttattatatattgttgtaaaggacaaagggaacaccctttctaagatgttaatacttacagttgatttgctcacccaaaattttccaccagttttctatctattgattgctataaattgctgtatacttttatgattcctttagcaaatatatgttaactgtagaaaaaatcttaaatgtcttcaatagaaatattacccaaatataacaaaaaaatcagaactctcccaatctcactacttgactgtataaataagaaagttattaacaattaatgtccccacaagaattataagattgtattattttttcccaacctaacttggagattttctgtttgctttttacccagtctttttttaaattataaattgaatatattttttccatttaattttttcctttacaaactttgaaattacatcttatttttttcctcttaaagattattatagaaaaatgtattttaacccgaacctaaattaaatctatatatttactgtttttccaaagaaggcaaatattatagagtgtgataacaattattttccctctcttgacacaagcgttctttcccagtattttattgccactgttccatgtaacaaaaattgactatttatgcacacatttaccaatttctcagcttactgttcttcttgtatccccaacatttgttttagttatttctaaaatttccaattcaaatatgtatatactgtgaatcttccagatttggtttttgtttcctttattctgcaagtgttgtagttttttcacataatttcctttttttgttgttcctttatcatcatccatgaggtaagaactgtgcagactctgattctcagaaaagacggttaattattaataattgtcagcatcccctacttttgtgaaggtcaaatctcagctatacagaaaggaccaaattaatttgcacagctctcaatcatgttctggattgaaataaagttttcttatgtatatatcttttaaactaaaatcatattttttatccttcactcaccagccccaatctgtgcatttttgccaggtataaaatatcagttaatacatgcaaagtgaaattttctagagttctaccagaattatttgcatatctggttcaacctatttcaggcaaataaattatattcttccacgttttatttttctatatattttgaacaatataaaacgattcaaaaatgtatgtgtgagatgccttttcatatattttcttgcatttctttttatatttcattgaacattttcatgatggtgtggtgatgtgtagcaatggagagcatagctaattacttcatcatatttcttggaagtcctcaaactaagattttgttagtaatttctgaggtatcatatttagtagtggagctactaaagtaaatagcattcttattttattttctctcttgtcttttctctcttctcttctaatcttcttccaggcttttggatatgttattcttcaaagttatataatttttatttctcaacatattattgctcatgtatggaatctatcaattttcatagtttcaatagctacctctttctcagaattcccagttctgtaatccagccataatatatactgtgagcttcaattctaccccttcagagtcttgtcaaatatctccattaacttatttattttgctatttctcaactttaagatacccaaactctaattctcttatttttgctctactttaatgattttcattttctaccatttcccatgtgttttatggtgaccctatttttctctattcacagggtcaaaatatcagaatttctttggtattaaacttttgcttgtactccaaagacttactaattctgtatcttcaatatctttttgtttttagtactcacttttctttccgtgccatcattgctgtttagtccatcattatatttcacttactaagaaataaaagccttcatactggctcccatattactgtcctcttaaagtcaccttcaggcatactgtaacccattctctttgtcatatatactctacttttccaccttcaagtttttatttacacttcttaagcatagtgacccacagagctagacatatgctgtaacttgtaacacatacaaaaaatatttgtagaaatcattactacatatgttgattaatattgaataagttctgtgggtacatagttttcagcaaaacagccaaagtgtaagtagacctacatcatcctgaaggatagagactatcatttttacttttgtttctttcaagtctatgtacacaacaagcttactgaagtatttttccaagcctgagatccttcctagcttttcccacctcttagaatggccttgaggtggagcagtgataaagaagagcagtaaccaattagatataccttttaggcttaaaagaactgtagcttcttatgtaagagcaagggattatctcagatcctgaaattatctaggtaaataaatattatttggtaatgattgttttggttgctttgtgttgcatgaagtatgactttggtttatgatacaaagactgctggcaatctgacatgagacttgctatcaaattggactggtgtctttctcgtcgaaaatgaccttgcactagttgatggggctttttgcccctctagagctggaagcacatcagtgtccacttgaatggcaaattgtgataaagtagcaggagcacaattgcatagcataatcactgcaattttttattgaattgagccctttgctctttctcttcacagaacagtttattgaatgtgcttgtggaaaacaaaggccgtaaagaaaaataccctttttttttatatattgagaatagaagagagaaaatgcgtctacttcaagactgcatttcttaaatggaagaacattttcaggtgcaagcggactctttagaaatatcataaaactgtgtcactcaagggcaattcagtgactgatgaggtttctatctggcagcctagtcagcttgaacaatggaagtttcttatgtcctttatttcagggaaatggagaaattctactagctaataaaatattttcattaaaaggtagaaaaatgatcttaacagatggctaatgttatattttatacattcaataataaaggatctgtcagcagcaagttaaagttgtgtaatgtacatgaatgaatagaaaaataattattcagagtttgaggtagagcttgacattggatatttctgtgtttgaatagtaactttagtcttgatgccatttgtcaaatttaaaataatccttactagcttttcttagcactctcaaacttagcaaactttatcaataaaatcctgaaacatttttcttgtagagtcttcatttttaaatgggaacaatgttgtttatcacaaaatagtttggtgaaatctcttggtactataaatgcttccacttccagacactagattttattactgtcatttgttttttatttctactcttttcaaaagattatttattccaatataattgacattttaattgatactataatctcagatcattccatttaagaaatctgtatttctgtcatatattttaaatattcctgaataaagtacaaaatagaagtgaatatcaaaggtcttgagacttttacccttttgtaaaattttattttttcctagtataatttttcttaagaaaaaatagaaacacaaattttgaattattttttgtattttgaaagttttatattgtcctttaacactaaatactttgatcacgtattaactgttttcctaaaagttacctaacacaaatattatttcataaaccagactattcctgagtatcttccaaggcaaggatcagaaacaatattacacttcaagcttggcagtcttagtatatatttctttcataaaaatcccatattttggccgaataggttgaaaaggctagcagatatgtactcttgctcattctctgggaatcccctattgtccatttgaactgctcttactactgataaatgtaaattgatagatttacggcaacaggggctaccaagaaactaacgtttagcctttttttttttttttgagacagagtctcactctgtcgcccatgctggagtgcagtggcacgatctcggctcactgcaagctccgcctcctgggttcacgccattctcctgcctcagcgtcccgagtagctgggactacaggcgcccgccaccactcctggctaattttttttttttttttttttttttgtatttttagtagagacgcagtttcaccgtgttagccaggatggtctcgatctcctgacctcgtgatccaccttgtctcggcctcccaaagtgctgggataacaggcataagccaccgcgcctggccacgtttagccacttttgagtacctagtaaatgtcttccatatttctcttttattggcattatatgtttgccaactggataaaacagtttatcattgaatattctgtaaaataaagagtttaaaaggggaggatattaaaaatagcagaagatactgtgagtttcagtcatatgcttccccaatcccctctctcccaggcctttctgcctttatatagtcataagtttctcacaatttcatctttaagtcttcaggactaagatcttacttgggtctaggaatgtttaggtaaattaaacattctagattatttctctgagtgttctccgtctttaattcagttaaatgagtaatgtatgtggaaaggaattaagtggtattcaaaaaacggtttgtcatatgataatatataattgattactcagctattgatagggctcacatcacatgaggaaaagttgaagtactaagatatattttatctgtgttgctaaagtataactatcaattttattaagtactagattttacatgttttctatacccaaattttattaagaaatatgcaaaaaaatgcaaagcactttttcaggtgagggatacaaacaactaaaatttttaaatagacaaaccacaaaaagagaataaaattatttttttcattttaattagtatttttctatgtaacagtcatcttttacctgatttttgtaccatctggtgtattaaaactccctactggcttataagccctaatttgaaaaataagtactaatagataattttcacataatatctcatatcttttcctgtaaatcaatataaataaatcagaaaaccgtgatttattgtccatcctggccctttgtatcaatcctgcccagattgtgtgggattcttactcttctggtagcttgttccttggcttctgttcctagcctagcttccttccatcactgaggcttatttccttccagctagctcagttgcatttccagccaggaaggatacagttgctgcaaatgcctctgctgctactgttctggcactgatggtctcctgctgttttggcataaatgttgcatttacacaccgggaatcctttatttggcatttgagagaactgttatcatggacatgatgaattcatgagccggagtgtgtttttgcactcacttctatttttcatttatgtggtatctattgttatggtgcctcaaataagcatgatttatcttcactgtgttacttatagagcatgatttatctttactgtgttacttatagagtacaatgtactttcaggtatgcattgcagcagattttgtggtcctatgtggttatgatgttttccactttatatttgtcctttttttcttttaactatttgtgttcatggtcagatttcttctttagaagacacgtgcaattgaaaagctcagcctttggggaagacatatctgagcttaaaactgagctcattccttattctgtgactgcaaaagttatttcgtatatacctacaatcttggtttcatcttgtataaatgaaaataatagtatgtttttagtaaagttattacaataattaaactagataatacatctaatatatgcagtacagggaagatgttaaagaaatgttagcatcccttttatgccaggacctcatttaattttccaaattaattagtgataaggaagaaaacatgcttatcaaagttggtccttggtagataatattccacggagataaaattggtagtagataaaattctacagaggtcagtcattctaaactgattttctgaagttccacagcaaaagctaagtacccggttttcttgcaaaattcatttgaagctataaaaattgggaatttacctgaagtgggattgaatttaaccaaggcaaggctgatattaaagaggtgcacagcgagcagttttcttgacagcatgttttaaagggggccaagaaatctcacctactaaaaaaaattcttcccaataaatatgcctcattcttattcacttccttaaaacttgataacatctgaccttgtttttgaaggagtaaatattgctcaaaaggatactattaggatgttattagtaactcatagcataatataaattgttgcattagacttttcttctgtagaaggggatttgggcaataggacttttgattaaagattggggcacacatgaaaagcataataaattttggtaattttacagatttttctggcctaagaaacattcatatcgataagcttcaggcttatgctttttcccactaagaaaacacactaaagtttatcaagaaggctgattcatcctgaagcaagtctaaagagagtagtggttcattgctgtgtgtttaagccataatcctatagaattttagtgattttcaaggcccagctgtgtgtagacgaaaaaaaaaaatgccccccaaaacattctttattttgtacttcattttgtagccaaaagataatgctgtaagtacggtgacaatctgttagacagccaattccattatgcttacgttagaaaatgaggcttattcctttatttaccctgaggcaaggaatagaggaaggctttctgaatcttggagaaatggctttcctctaatcttagggccagggtgcagactttgagaattaggtctcttcagtcattatgagtaatgttcaagtcaccatggcactttgagatatagcctgtgtgagtgtaagcctaatatgtttgaatagactggaattatgtagaaaaaggtaattggagctcttgattagacatatttgttgcctttgaaaacttcttggcttcttttcaggaagcacctttgcagcagatttaacaaggcttttctaggctactaattcaccagacattttagccattcttgcctagttcaataaatattacatgggaattgatgggcataagtgaggattttgatacaaacactctgtggaattaactgcacaaaagaatgaggcttcttggctggaagagcagatttctggttgtatcttgtaactaggacaaattgcttttgtattgaagcatccatatgggtttacatgagtagaataatcaaaaagaggaagacaacttatggaaggttgtcttactattagtcagggtaatagaatcaatatctatatatctatatatttacatacctatatctatatcttaagagatttattttaaggaatgtcttatacaattatggactctgacatgtcccaagatctgtagttcaaaagctgaagacccaggaaaagccaatggtatagttccagtttgaatacctgcatactgaagatccaggaggagccaatgtttgaattcaaatacaaaggtaggaaagaaaagatgtcccagctttaaattatcagacatgaggagttcactcttactcctgggagagccagccattttgttctactcaggcctttgactgattggatagggcccacccctattaaggcgggcagtctactctactgaatccatccattcaatggtactcttatccagaatcaccctcacagacatactaagactgtttgaccaactgtttggacatcccataatccaaagtggcacataacctgtgccattacaaatgtttagccaggctaacttcaaattcatgattttttttaacccattggtttactaagcttgcaattacaaacaacgagccccaaatctaatgaataatgaagcctgcagggagaaaggagttgagaacttgtttgcctgcagtagaagcagttgaattacagtaagaagagtaagaatagtttaaaatgcctcccaaaacattcaaatggtatagatgtagcaagggttggtggggcaataggaaactcatgggggctttagaaattgggtaaatctgtcccgtcttgtaggcttttacttgaaaacttcactggatactcagaaaaattggaaagaactctaagaaatattgactgtgatctaaccttaaggaaaagcaacagctgtgcagttagatgcaagaatctcctggagccttctccccttcagaatgaaagttttaatctgtggtttaagaacaagtgctgctgccattagaacatcagttgccactcagagaaggaagtagaagaaaaaaattaacttttggagaggaaggactacctagtgaacccaaaactagggtgaggagcaagataacttataaaagatataccccagagacatgctgcatatctaagatgaggcttaatcagaagaacagggactaatatgtcccccttctctcaaggcacatcactccccactgccaacctaacatattcagaatactgctagaggatgacagaactagagcaaacatatagaccctctctaagcacagggcaaagagaagaccaaaattcaaaattgctaatgtttgctctggtagccattcccactctaggcacaagttatctctataggagattggagtgacaaagaaagcttattaaagctttctaaatttagacaaaaattataatgtcaaaaaagtaaagtacttataaattaacaaaatacatgcagaatgtatatgccaaaatctacaaatcattgattataaaaatcaaagatctacataaatggtaatacatggagtgctcatggattggaagatacgatgatttctaagtaagaataaagtctttgaaaatagtttcaatgcaattcaaatcaaaaccccagcagacttttttcttctttttcttttttgagacagagtctggctctattgcccaggctggagtgcatgacccaaacataattcactgcagacccgacttccagggttcgggtgatcctcctgccttaagccttaatttttttcttatagatgtcagtaagcttattctaaagtttatgtgcaaagatgaaagaactagagtttcaaaattaattttgaagaaaaacaaagtttgactactcactacccaatatcaaaatttaatataaaactacagtaatcaaggcaatccagtgtaagtaatgattacatacacattaattgaacaaaatagagagctcagaaataaacccacataaatacagttaactgattttgacagaggtgcagaggcaattcaatggataaaagcctgtcaacaaatgatgttagagctactgaacatttatatacacaatgagcaagaaattcatgacttatactgaaagctaatatataattaacaaaaaataaataatagagtttaacgtaaaatgcaaaaattataaaactctgagaaaaaatcgtgggagaaaatgtacacaattatttgctaggcaaaaggtttttagatacgaaagcataatctataaaataaaacattggtaaattggacttaatcaaactttaaaccttttgctctgtgaaagatgctgtcagaagattaaaatatatgccatagactgtaagaaaatatttgcaaatcacatttctgaccaaataaatttgtgtccagacatatgaagaagttcctaaactcaacaataagaaaacaaccaaacaaaaagaggtaaaagagaatttatatttcagaaaggtgaagtactcataaatgtccctattcttcttatgaagtataactaaaaactctggacattatgtataatgcaaatataaaataactgtaaatggtggagagaacacagacacactagggtacctctgacccaagaaattatgtggtggtgaatttcttgggttttcattttgccttacatattctaaaataggaccagaagttggaaacctagaaataccaatgggcacagacaaaagaagaaaagccctctctagccaaaggatcagaaaagagacagcctcaccaaatagagaacttttagacaacttctctacacaagccaaatgccacagaaaattaactttggtcccctccctgatccatgccagtaaagttgagtagagttcatagattacactctcatcaagttgtaacaaggtgcctccaattctgactgccttggtatcacacaatgttaaataagaagtttggactttcatctttaccattcagtaactaagaccccatagtgtcactggggaccacttaaaaactttagactttcatcttcctcaggaagtaataaggtacctctttctagctctgccatggtattgtcagggaattgggaagagggaaacagaatcacacaattagaacattacattaataattaccacaggcaacatctgatgcatgctaaaactagtggatataaatttaaataggtacaaaatatgcacatagtttctaagtgtccttccctcccccaaaattatttaacaattaagtaggaaaaaataataactatagagtggacaatcgaggcatgtaacagtttaagcaagtatcaacctcatatatttcctgatgtgatgtgagaagacatcacctttgcatgatccttcttaacaatgcatagcctgagtctattcgtgagaaaacatgagacactctaagttgcaaaacattctaaaaagtaactactttaaaaaagtgttatggtcattaaaaagtctatgataaactttgagttaattttgtaactggtgcaattaaaggaagagtcagtatttatttttattgtttttccttataggtcaaccaattgttccagtgcattgaagggctagcatttcatcatcgaattgctttgtacctatgttgaaaataaaatggtgatgtgtatgtggctgtatttctggactctacttcattccattaaactctttatttttggccaataccagacaatgtagactactgtaaatatataataattcttgaaatgaaaagaataacatctcttagtctttttcttttgtaagaattggtttatctcttttagattctttatatttccgtatatattttagaattagctgctctatttctttttcaaaaaagcctattgcattttttgttgaatctacagatcaatttagagagaatttgtaatataacttccatctaagaaaattgaagagaaaattaaacacaaagcaaattggcatgctaccttcccatagctttgacatttcacaattgaaaaaaaaaatcattaagcttcatcatggcagtgaggaaaagatttgtaaaaaggaggaaagatatgagtaaaattagttcattgtaggatttgggcccaaaaggaattaggaaacaatgaagatatgctgctcagaacctggccataaaccacatttttgccttttgtcccaaggatttctcttttaaaatcttttggcacatactggctaattcaaaaatctgtaataaagtttttcttttttcacatggttttaactgcattgtgacatacatggagtccagctctttggaatctctttaccagctcttttcaatttctttaagtagtgcttccaggtttatgctatgtttaaccttccctgactgttcccgtctaaagttggtcttgtatttctataatcacacttctatatgatcacagtgtccccttatattacttatatggctagaaactatgtgttcatccatattagtttagttagtccagtatatcttttcacttaaacaagaatgttatatgctttcatgttcacatatttaattgtaaagacagaaacaaagcagaagtcagattagtctccttattcttgtcatagtttttcatttctctccttggcaaactggttttatgttaataccaatagattagaagtggccgtctggaaggctgtatgggcaaagactgagaaaccacatctctagttagtagctaagtgatttgaaaatggcaaaatcaattaacaatatctgacagtgatttgggcagaagctgccagtgtttcaaacctgcattatactattggcccaaatgcagacctattcctttgctagtcctctcattataaacatggttcaaaagggatttataatgttattatctttgtctaggcttatcatatctatcttatagtttataggaaagttctagtcattgaatttggtttcatatgatcatttttaatcactgtatttgcattcctatttaaaaccaagctgatgcaatctctctctctctttctctctctcactctcatcatcctccctcactgctacccctcccaattcgctggtaatcaatataatactcttctatgaaatcaactttttataggcctataatggatagacaagtaaaagactggtctttcagaacagatagtttgcaaagtttttggtgaaagaatttgattaacttaaatgacaccctacatttggaaaaggattataatctaaatatgaaatctttgaaacatgggccttattagtcctaattattttatgtaaaattattttgtagttttaatttgcattattttcttttttaatcaatttttatttgtaagtgacataatcattgcacatattggttgggtacaatatgatgtttcaatgtataatgatcaaataagactaattactatattcattactttaaatatttataatttctttgtggtgataatcaaaaccttctcctctagctatgttcaaatatacgctacattatcatgtgctatagtcatcttactgtataatagaacactagaacttattcttcctgtcaagctgtaactttgaatctattgaccatcctctctcaatcctccctcccaattctctggtaatcaatataatactcttttatgaaatcaacttttttagattccacaaatgcatgagatcatgcagtgtttgtctttctgtgtctgacttattccacttaacataatgtcctccaagttcattcatgttgcctgcagtgacatgattttattctgttttatgactgaatagtatttcactgtgtatgtatattatattttcctcattcagtcattagtagatgggcatttaggttgatatttttattgtctattgtgtatagtgctccaataaacattggagtgcagatatcaatttgaaacactgatttcaattcctttggatatatacccagtaatgggattgctgagttatatggtagttccatttttagctttatgaggaaattctatactgtttcacataatggtggcactgatttctatcccagcaacagtgcataagagttcccctttctccacatctttgccagcttttgtaattttttgttttgttttgtttgtttatttttttatgataatcattctaactggggtgaggttatacaacattttggctttgatttccatttccctaatgattagtgatgtgtaattttttttcacgtaacttttggccatttgcatgctttcatttgagaaatgtctattcagttcttttgcccagtttaaaattagaatttctttcgctgctaagggttccttacatattctggatattaattgtttgttggatgcataatttgcaaatacttccccccattctgtaggttgtctcttcactctattgatttttttctttgctgtgcagaagattttagttttgtgtaatcccatctgtatattttttattttgttgcctgtgctttcaaggccttactcaaaatattgttgctgtccaatttcatgaagcaatttccttatgttttcttttactagtttcatagtttctggtcttacattgaagtctttaatccatttagggttgatttttgcatagggtgagagatagttatatagttttattttttctataagtcaatactcagttttcccagtactatttattgaaaagactgccattccctcaatgtggatccttggcacctttgctgaaaatcagtttcctgtaaatggatgatttctgggttttcttttttgttctgttagtctatatgtctctttttatgccagtactatgttgtgttacttactatagcttttctgtatattttggagttaggtaatgtaatgtcttcggctttgctctctttgttcaacattgctttggctcgctggagtcttttgcatttctagataaattttgaaatattttttctatttctgtgaagaatgtcattggcattttgataaacattgcattgaatctatagactgtttttgtaatatgaatattttgacaatattaattcttccaatccatgaacataggatatcttccttttttttttgttcttttccatttctttcatcgatgttttattgttttcattgtagagctctttcacctccttagttaagtttattcctaggtattttttgtagctattgtaaataaaattgctttttggatttctttttcagatagtttactgttgacaaattcaagtgctactgatttttctatgttgattttgaatagaaatttgtgttgtttctaataattttttttggtggagtgtttagggttttctatacattaatatatgtgaaaatgttatctgcacacaggaacaatttaacctcctccattcaatttgaatgccttttatttatttctcctgcttaattgttcttgctagaacttccagtgttatgttgtataaacatgggacgagtggacattcttgttttgttctagatattagaggaaaagcttttaacttttctctattcaatttgatttagctgtgggtttctcatatagggcctttattatgttgaggtatgttccttctatactcaattcgttgacagtgttttcatgaaggtatatttaattttatcaaatgctctcccagcatctattaaaatgatcatgtagtttttgtccttgattttggtaatgtgattgtgtttattaatttgcatatgttgaatattttctgcatctctgagatgaatcccacttgatcacagtgagtgattatttttaatgtgctgttgaattgagtttgctagtattttgttgaggattttttcatctatgttcatcatgaatactggacattagtttccttttttgttgtatctttgtctggttttggtatcagagtaatattggctttgtagaataagtttagaagtattccctcctttcaattttttgaaatagtttgagtagaagtgctattcttctttaaatggctagtagaattcagcagtgaagccgtcaagtcttgggctttctttgatgagacactttttattatttcttcattctcattactcattggccttctcaagttttttatttcttcatgattcaatcttggtaagtttttgtgtccaggaatttatccatctcttctaggttttctgatttgttgggatatacttgtttgtggtagtcacttattatcctttgtatttctgtagtatccattgcagtgtctccttttatatctctgattttatttacttgtttgttctctctttttttcttggtctagctaaaggtttgtcagcattctttatcttttcgaaaaaacaatagctcattgttttgttgatttttttatattttgtctctattttgtttatttttgctttgatgtttattatttctttttttctaattattcaggttttgattgttcctgtttatctagtcctttgaggtataatgttaggctgcttatgtgagatctttgtatttttttgatgtaggctcttggaaatgaggtttacagaattctgaaaactcacttaaattgaacaaacttttagctgtaacaaaagctggcttaatgtgcatattgaaactaatattccttgaaagtgttagcttcaaaagatatcagagatatcatttcaagaagtctgtttctataaacttttctcttagaactgcttgttttccatgcatttaacgtcacatgaatacttcaattagtttaagaattgactgcagattttcaatgcattgttaaaagaaaatagcctgtcctaaaccaaagatttctcatcaacatccacacaaaagtttttagtgaatcactagattctaggtgcaaattcattgttatgcaatttgaaaactaaaaataatactatgatatagttctttagtgggcacagtatagcttatagttaataccttctggattcaaaaatattttatctatctgaacagtttccctgacaagtaaattatatgataaacaggtctgtggacaacttaagtgctttgacatatcttataattcatcatttaatcttagaaattattttatatttctatttaatgactattgctctatttcatagattaatcattaaatcttatacattattttatatctatattgttaaaaagtaaatgtatttaaacacccataaagaaatacattactgcaatttattactatccaaggtagttttgaattaaatatttcaattccaatattgacaactatgaaggagaatttagaggtgcacttcaatattatgttctcttcttttactatgaaaaatgttgaaatacatcatgagtgagatatctttgtttacaactctagctgtgctcttatgctttggtcattcttcctgtcccatttgcttttcttttgatgtaacctcaaagagtagactaatgatgcaagttcgtgaatgaaaaataatactacatgtaaatacttgttcttttagtacaaattatttgaagccaaatatatggatttgactagttattaaatcaagatcttgtgataagaacttaccacatctttaagtggcatactttaattggcttctaactatgtagaagttcttggcattttatattaatagtaaaaactaattggaaataatgttacctaaatcatccaaacaaagcagtttttagctagctggcctggttgcagtttttctcaatatctcattgaagtactcttgaagatatggagtaagtgaactgataatctgatagaaaagactgaacagaaaacctaatgccaggttctggtaaaactcgactattattatgaatagatggaagggtgttaagtgtaatttagccacatttggcatatgatttattttagttttgctttataaagcaaaatacctgataaaaagcaacgatatgatttttcattccttcttgccagaatctgtaccttgtttcagaaacttagagatgaacaaaatggagaacttggcacttatttcctctataactcttggagttacttcctgaggtaaagagaatccttgatttctttcctgcttccccagataccatctttctgtatctggggagagactgccactctcagaaaataacaggaaataaaagacttacaggtaatgcctggaaataataaagtaatacgtatgttttttaaataaaaagttttaacctgttagaaaagaatgaagacaacaaagacattttcaaatatgcaagccctgtttttaaaactgagatataagaaaaacaaatttactctaaaaaggggaaataatggaaacaagaattatgaataagtcctaaaatttcatgcagttatcaaaagctacttttgtaaaaaagacatatgttgtataaatcatactataataataataatttggccttagaatcctaaaatgcagtaaataggcatggaaggaatgaaacattgcccaattttctttattaataatgaaaaacaaaacataccacttaatccttgactctgaagttaaagtaaatattttaagcaatgaatcattttcagacacttaaaaagataacagtgatataatttaaaagagactataccctctcaatttttaaaaaacattaatcatatatagcaggagagctaaaacaatacaaagcaaaaaattcaagtatatatataaaataaaagaaatatatagaaatggattaaacttccatatgaaaaatttctctgactagatagtaataatgagaataacttctaaatttattcaactcacaagatccatacctgaaacaaaatgacataacatagcaaatattcaaaaaagaattaatgtatataacaggttttttaaaaatgtcaaatgcaaatacttcctcgaaggaagggccttgtgattttgagttttgaattgagaaaccaagggattacacctcagaaataatagtaacaagaagtaaactatccatcagtgagagagaagctcaggtacagtctttttaatctctgattgaattaagatgacttggtcccctaaatccctggcagtaacaaatttaaatttaaaaattttttgtatacttttaattaattaattaatttttgttggagacagggtctcactatgtttctcaggctgctctcgaactcctggactctagtgatcctgctgcttcagcctcccaaaatgttataacaggcatgagccatttgtattgagataatttttacttatatttaccagtgtccattcccccttcttatattcattcattcattcatttattatatattttgttctagtagatgttggtgaatataatcatgaacagcaagcatttattaattttatatttattaaacaattaaattaaaatcaattattgattttatttaccatcatagcccatgtgatgagccctggaggaaagaggtggggggatgtagaactgagtgctatcagcatccagaggtaatagaaaacttaaaaatgagcatgctgttccacagacagaatgcaaagtaagaaaagggttgggtaatgtctctcccaatcaaagaacaaattccttcttgagtaacaaatctaatttctagattgactagagggtgaagctaaataatcttttttaaaataaccatcaaagccagtttgctaatttaacttattatctgtgttaaacaattcatcccacatctgcaagagagtggccagaaaataaatcgatttcttaatgaaaagattttaattttcaagttaattccctgttagtcactgctgagaagcacatctattttttttgaaattgcatattgctttacaaaatatgacagctgttttcttattttctagatttcaaatagcttattttgaactttagaaatgataaactgctacattagtgccacctttaacaggtttacattaattgtgttttatgtgtgtaaactgaaaatctattaattttgcctttcctactcacttctagtaaactctccattgataatgtgccctatttgatttttaaaaaagtgataccaaagcagttaagtcaaataaatgaaagaagagtacaaaatataattcaaaatactcattctatatcacgctatcagtttatatttagaagtacattacccactagggcccgcttgttgaagcaattgtggactttatgtttgttatttggtcatcaaaacttctgtctaagtacctagggatctgttgggaacaaaatttgtcattctgattctctttaatgcttttcattgtctgtgagaaaatattgtatgggccattggggcccatttgcaaaggtttcttctttgagcaaaggaagctgttgctggtatcattcactccagagatttgtgagttgaagaatgaagtgtcaaaagtgaaattaagacacagaataaacatgtggtgaactctagtagtacctgatcaatagaaaccacagcatgctgttatataatttttaaaaaattgatttgaaatggacaagtccagagttttatatacttaggttccagaggccctaaatttaaaactgaatgactattttctgcagatattgcaatagcttaatttgcatttcatttaatattatttcatttcaaaacatcaaagttgatgaattctaacattctattataatacaaattgcttgcttattaggtattcatagtcattattatgatgtcatggggggattttaaagatacgctaagtaaaaacaaaggagaaaagaattttgtgatattaaatcaattctatccttaccaatttgtttaaaataatttattttgtaataacaaaatttattatataaatctaacagcattgtttcagtgctaccaatgtccagtttctttttaccatgttcactaattttatggcattttttgtgtttttttcctgaagaccatttataatacctttttaaaagtctttatataaaaatgcataaaatatttaaaactaggtttagaacagtcaagatgattaatgagataagtagctcataaaaagtaaaagataacaatggcagactcgggtagtaacaataaattattgaagactgttaatgtttgggattttgtgtctgcataattagtcatatctctgtccagacagcagtgtttgtgagcatttcaggccagatggtacaacaaagaattgaggggaaaaaaaagcaaagacaaaaccttatcatttcatttatattttttaacttaagtagaagactacaaattccaaactattaacaactgattgaatttatctgctctctgtggagtgccaaattttttttttttcattacaacatagtagtaaagttaggaaaaatgaaagtatttatgattacttttcttttcttgtataaattaaattgtcacctatggacatgttaaggtaatgtttattaatacggattttaaataagttttaggaattttgtctcagtgctttattctggtgtttttatctaatgaaatgtagatgtaaataatgacatgaagtaaaaggaatctagttctttgacatttcacttgccttctagtctaggaagagagcactgaactgagactcagttgactacaattttgctcctaaatctaccactgaatcaatcacctatctgtcaagtaaatggtaaaattattcaacaagatatattaaatctccctaaaatgctgtaaagttgatgcactatggtataaaaattaaagagtcaaggctttatttaacattttgattttgatatttattataagattatattacagatgccttgtttcaataagcccctgtggtttgtttaaatatgaaattaaattttgatagtaaataaagtttaaaatatattaatgataaagtaagttttagaaggcgagatttaaaaaattttctttgttattatctattttaaggctctatacaaaaatacattctttggtttcccagttcaaagctcaagatcaccaagttccctccttaccggaagcatatctgcatttaatatttgttgtcattcattatatacattcttctttctgaaatatttaccatgttggatcattttgttttaggtatgcatcttgtgaagtaaatagatttagagataattattatcattattgttatccagccagatagcttttttgtaagtaagctttaaatagataataaattaagcttctactttaaatacatttgtttgataaatatcattgtaattttatttaacacatattttaaggaaagataaatgcaaaggcaaaaagataaatttaactgaaacttaaagattctgaagatgaagtaatataaaaatagaagctgacactattggcataaatttgcagtgctaattaagttgtggtctactggttcccatatggtttgcttggctgccatgatcactgttctgttacctccagggctttaaagaaaatatgcaaataaggggaggcccacatggccatggcctaattagaattgggcagtttgcctaggccaaaattgagtactttacttctcctttctattttccttatgtcaaattattttaaatctgtttcgagtgaaatagcaaatgtttcttcttgcagcaaatatctttgcctattggtaaaaataattgaactcaaaaaatattcataaaggtctattatatatagatgtatactgtccatgataaaggaaaaacaactactgtaatatagtccctgctctcaagaaggttctaataaagtaggaaggaagcataagtatgtaaacaaatagctattgtagatatacactaaattatagttgttttcacagcgggtataatcatgtttgcctgggcaaatcaagcaacgaatggaatcatttcagtgaacatttaattccacatccatctattgtctcttgggtgatagataaagtgttacttattggtaatatactctcaatattttctagatgtgaaaatggctagaaaatggttggaaaacagataaaaatgagttagtgcctaattattagttgaggatcaaatggaaatgttttgtcttcccaacactgttacatatttaaaactcttccatgttgcctgtgtgcaaattcttggctcataccttgtttcagtcaggaatttgtggaaatttctccactgtctttggacattgtgaaagtatctgagactattaaaaaacgttctccttgcgagttatttagtcttctgtctagaagcacaaatgatagtttctctactgataactttagtaggtaggatatatttccatgctgtccattctagccaatttttttttctctaaaatcaaatttgtctacctaaatatagaaatagacttgtattttaagactctatttatttatatacctgtaaatattatgttccacttttcagaacttcctatttatttctgtcagaatcatcctaattttgcctaaatttctgttatgttttaattttaatgtcacatcttccctgatctctttcaatttatatttatctcctgttttcttgtcatctcttccccaattttttgtatctttgcttgatgctcttggaagtaatatatttattcaattttataacttcctgaaatttttggccaaaattttcatctattccttggtatcctggattgaatagtgtccctgaaaaattcatgtccactcagaacctcagaatgtcagtttattgggaaacagggtctttgtacatgtaataagttaaattaaaatgagattatacagaattacggtggcctctacatgcgatgaccagtatccttataagaaggctatgtgaatacatggacacatcaagaaaatccatgtgccaatcaaggcagaagttggagtgatacagctgcaagccaagaaatgtgaaaactgactgcaatcaccagaagctaggaagaaataagggaatatctttttccagaaagatactgcaccctgaagaaacttccaatggtgcatggacctgccaacaccttgatcttgaacttttagcctccagatctgtgagagaatacatttttttctttcttaagtcaatcactttctggagatgtgttatggcagctcctggaagctagtttacttggtaatgttttgtagtgagtgttcttcatcttccacaaccagatctgtctgttaaagaagtggcttttttctttttaatcctagagggcaaagggaatatttgagactaactgaaatatatgtgaatgatctagggatggatatatatatatgtgtgtgtgtgtgtgtctgtgtgtgtgtgtatgtgtgtgtacataaatatttttttagccatatcataaaccaatggatatatgcaattataattttacacacattaaaagtctttctgcactgatgtcatggggctagaatagtggtttcaaatatggcttatgtttgaagccatctccagcctatgcatccatattaaaacatttttgtgttactataccttaagaaatatctaaggctgggtaatttataaagaaaataaatttaactggctcattgttctgcaggttgtacaggcatggcaacagcctctgttccacttctggggaggcctcagggaccttttattcatggcagaagacaaagtgggagcaggtatgtcacttggtgagaattagagcaaaaaagtaaggggagagatgtcacacactcttaaataatcagatctcatgtgaactcagagagagaactcactcactgtcaggaggacagcactaagccattcatgagggatccaatcccatgactcaaacacctcataccaggtctcccctctaacgttgcagattacagttaaatatgagatttggagggaacaaacatccaaatgacattatttcacccctggctccccaagacacatgtccttctcacattgcaaaatataatcatccattttcaatagtttcccaaagttctaactagttctagcatcaacacaattgaaagttcaaagtcccaagcctcatctgaggatgaattcctttcacctatgagcctgttatttacttctaagatataatgggaatatagacactgggtatatattcccatcttaaaagggagacattggtccaaagaaagaggcaacagaccacacacaagcctgaaatccaacagagtgatcattaaatcttaaagctcccaaataatcacctttgactttataacgtgcattcaggacacactggtacaaggggtgagcacccaaggactctaggcacaatctgcaaactgctggtgggtctactattctggtgtctggagggaggcaggcccattttcacagcttcactaggcagtggcccagtggggtcaatttgtgggggctccaacactgcatttccccttggtattgccctagtagagcttctctctggagatacatttctgtggcaagcttctacctgggcatccaagcattctcataacattgtttgaaatctagggggaagctgctaagcttcctttatgctttcattcggtacacctgcaggtttaagaccatgtggaaaccaccaagtcttgtggcttacaccttccagaagggcagcccaagctatatatgggtccctttgagctaaggctggagctagagaagcctagatatggggagcagtgtcttgaggctgttcagggcagcaggaccttgggcctggttcctgaaaccattctttcctcctaggtctctgggcctatgatgggagggggctgcctcaaagatctctgaagtgcctttaaggccttttcccccttgtcttagatattagcatttggctcccttttagtcatgcaaatctctctagcaattggttgctctgcagcatgcttgaattcttcccttgaaaattagcttttcttttctactgcacggctaggctgcagatattctaaactttcagctgtgcttcccttttaaatataagttccaactttaagtaatttctttgctcttgcattgaatcataggctgttagaagcaaccaggccacatctaagctttgctgcttagaagtttcttccgccaggtaccctaagtcatcactcttaacttcaaacttccacagatccctagaacatggacacaattcagttaagttctttgttagggtataacaagagtgacctttgctctagttccctataaagtttacacttccatctgaaacctcatcagcctggctttcactatccacatctctatcagcattttggtcataaccatttaaccagtctctaagaaattctaaactttccatcatcttcctgtcttcttctgagccctccaaactcttccaacctctgcccattatccagttccaaagctgttttctcattttcgagtacctttatagcaatgtcccactcttcactaccaattttctttaattattataaagaaatacctgagactgggtaatttataaagaggtttaattggctgaccattctacaggctgtacaagtatggtgccaacatctgctctgctctgcttctggggaggcctcagagagcttttactcacagtggaaagcaaagcaggatcaggcacatcatatggtgagagcaggagtaagagagcaaggggggaggtgccacacacttgcaagtgaccagatctcacataaactcaaagacagaactcactcactgtcattaagacagcactaagccattcgtaagggatccagccccatgaccgaatcacctcctaacaggctccatctctaacattagagattacatttaaacatgagttttggaggggacaaacatccaaaataaatcagcattgaattactgccaccacatatatggaattttggttttgtgtcacaaaagccacagtctggtttgtgtctagggcttgaatttatcaaggctagtttttctgtgtataatttttctcattggctacggatgacattcagaaagacaaaaggtaatgtcaatctaataccatcactttctcacagaaagtttttagtctaattacttaaatgggaattcaattttgatggtagtccaaagtaaatttggctctagttattctgttaagatatagtttgatatagtgggttgagcatttaggaaccagaacccagttgcaagatataaatcctaactgtgactcttcctatatcttttagaaagttactcaactttcctttgtctcaatgtgcttatatataaaattataataataagcagctgtctcttaaggttgctgggagcacaaaatgagttacctctgtgaagtgctcaagatcagaggctaatatatggtaggtgatgttcaccatttttattctcccgcacatgaaaatactttattgcaacatgtcttaaaatgtagttattcaaaagtgtagactcctgcatattctttcaaagtttcaattttgttgaagatttaaaaaaaattgacatattctacatgactcaaatagaagtcagttggtgatttatcactaatttaattatgattcatttgtcatcagtaatgagctacagtgccaaacatggtttccactttcaaaaataaaattcttatttttttctgtagaatatttccatttaaaattctttagtttctctctaaatttcatgcaacaaaattcttttaaattcacagaaatttctttactattaaaaagatcctggtgatagattcatattcagataatgagagtttagagtttaaattattactatgagagttaaaactatagtcataggaaaatgaatacatttattatttaaccctccacctagtataattttaattcttaaccagattaccctatcttttcaaattattactatttcacatttaaaaaatgtagtaccttttagaataatcttctattatattttggtgatgttgtccaaagatagatttgctcaaggtaggcaaaagaacttatccttccttgggaaccatcctgatatttgcagacaattgtcacactttaattctgtccttgtcattactcaataaagtatacttgttttaattccattaagattactcatatgttaattctttgtttattcactcattgtgctgctctgaatccccataatttttatgtttttattaaagatatatcctgaaatgaaaagcaaagggatacatgcaattttgtaagttaaatgatccccatgttttatgattttctagagtaaaacaaaaattcttgtaaaggctaagcttgtgaatagttattcctgtgcttttagagaagaatatatttagtgttgggtcataggactgtgttgcatgtgtctcatgcacctatgtatgttagtacaattgccagattggttttaaaatgaccaagctattatagaactgtgtatgtaattccaaaacattgaaaaaaaattctattttggaaatttactggaagaacagtcatcagtgtaacttaatttcttactgaaactgatgggtgctttttacgtgtggatacttttcatgacagtatttaaatttagtgtctttctagtggaattgacccatctcattatctgggatcatccattctgattttttgggcttttttttaaaccataaaatgttaactttaagcttcaagacctcttgatattagatgggaaaaaaattaactactaaaaaatgtctttgaaaaaaagtaaactgctatgttgaaaacatggttctcaacatgaaaaaaagtttgagtaatactggttagtttttacttgttagcctctgtattagtccattttcacacttctgataaagacatacccaagacggggcaatttacgaaagaaagaggtttattggacttacagttctgcatggctggggagacctcactcacagtaatggcaacaggtgaaaggcacgtctcactttggggcagataagagaagagaattgtgcagggaaactcccctttataaaaccatcagatctcatgagacttattcactatcatgagaacagcacaggaaagacatgcccccatgattcaattaccacccactgggttactccaacaacacatgagaatcatgggagctacaagatgagatttgaatggaggcacatagccaaaccatatcattctgcccctggaccctcccaaatctcatgtcttcccatttcaaaaccaatcatgccttcccaatagtcccccaaagtcttaactcatttcagcattaactcaaagtctacagtcaaaagtctcatctaagacatgacaagtcccttctacctatgagcctgtaaaatccaaagcaagttaattacttcctagatacaatgggggtacaggaattgggtaaatacagccatcctgaatgggagaaattggccaaagtggaggggccacaggctccatgcaagtgtaaaatctagcaggtcagtcaaatcttaaagctccaaaatgatctcttttgaatccatgtctcatatgtgggtctcactgatgcaagaggtgggttcccatggtcttggtcagctccgcccctgtggctttgcagggtacagtctccttcccggtgctcttatgggctggtgtttagtgtctgtggcttttccaggcacagggtgcaagctgtcagtggatctgtcattctggggccaggaggacagtggccctcttctcacagctacactaggcagtgccccagtagatactctgtgtggggacttccaccccacattttctttctgtactgccctagcagaggttctccatgacgatctcatctccatctgagacgacctcagcctggatttcattgtccatatcattatcagcattttgtgcaaagccattcaaccagtctctaggaagttccaaactttcccacatattcctgtcttcttctgagccctccaaactgttctaacctcagcctgttacccagttccaaagttgctttcacattttcaggtatattttcagcagcaccccactctactggtaccaatttacagtattggtacagcaaacttctgcctgggcatccaggtgtttccatacatcttctgaaatctgggcagaggttcccaaatctcggttcttgatttctatgcacttgcaggcttaacacgacctggaagttgccaaggcttgaggcttgcagcctctgaaaacacagcccgagctctattttggcccctttcattacagctggagcagctggaatgtagggcaccaagtccctaggctgcacacagcaatggggaccatgggcctggcacacaaaaccactttttcctcctcagcctctgggtctgtgatggaaggggctgctacaactgacatgccctggagacattttccctattgtcttggtgattaacattcagttcttcattatttatgcaaatttctgcagctgggttaaatttctcactaaggcactaagaatgataagaatgataagacattagtttgataacagcttctattagagcaatatgaattctgctaaaattgaagcaagaagaaaacattaaatttatattgaaacttggatggaagtttatgggtacaatgccacaaataaataatcagtttacaaattgatgattccttttaagaagggacaacacagtgttgaaggtgaagcccacagcagtaggtcaaccatatcaatttgcaaggaaaaattcatcttattcatgccctgattgaagaggaccaacaattaacagcacaaacagtagccaacatcatagacatataaattggttcagcttacatgattctaactaacacattaaagttgagcaaacattccactaggtgagtgtcaaaactcttgcacccaagtcggcagcagacaaaagcagagttttcattagaaaatttaaacaagtgagataaatatcctgaagcatttctttgaagaattgtaacagaagaagaaacatggatttatcagtataatcctgaagacaaagcacaatcaaaacaatggctaccaagaggtgaaagttgttcaatcaaagcaaaagtgggccagtcaaaagcaaaggccatagcaacagttttttgggatgctcaaggcattttgcttgttgactttctgaagggctaaaggacaacaatgtgtacatattatgagaaaaccaaagctttagaagaaaactgcctagaaaagttttaccagagcgtccttctccatcatgacagtgttcctgctcattcctctcatcaaacaagggcaattttattgattgtaaatcatttgcatccaccttaaagctgtgatttggctccttctagcttctttttgtttcctaatcttaaaaaaatatttaaaggcacccctgtttattcagttaataaggtaaaaaagattgccttatcaaggttaaattcctagaaaaaattgcagttttttaaaggatagactaactggctgatattattttttacaaaagtgtcttgaccttgatggagcatgtgttgagaagtaaagtttatatttttaattttcatcttttaattccattttttttcacaaatttttgaagtccccctagatatccccttttactcacttagatagtctatgattggacttatctatgtatcaatttattttgcattgctcttgaacttctatcctcattaagttgctcttgaaagtggaataaacatatataaaaaataggttactcatgataatcatatgtatttacaaaacattccatttaatttttctcttaaaagcattctcaacactttccacatatttatcattcttaaaattatagtaatcaagtgtttgtttatatatttaataactgataccaaagcttttgtattgacattcttaattgaattttagtctaacaaatgaagatcccaaatgacactattaatagaaatatgattagtccttgtataaattagagtataggctaagaagctgctaccaaaaaagctacaaacactgtagcttacataagaaaaaaggctatttcttttccatttaacagctttgggtagacaaattctgttttagttgactgagctatccagggacccaagcttgaatggaatggaggctctaccttttttgccatacacatggcttcctacacagtgaaaaaagtagctgctccagtttcaggctttgcattgttgaaggaaggacaccagcactatgaccactttccaaaagcagattgtagttttatagccaggtaggcaagccatgatcatactgcagtatcagtcttcatagcagtcacttgatttttgcctgtatccccacctgcatccccagctcatttatgtagcctcctcatttgccacttcctcactaatatcacattctagctacgaggagcaaattataattcacaaatgtgccctataatgcctgtaattttcctgtttttccatgatgttttatatacctctaatttcctttattagcttcattaactacttcttagtctgaaatatacacatctctgtgccttgttcacaatatattatatatcccaatgatattgtaagcacctcataggcagctaccatgagttacagtcccggttatgctatttctgagatgtgtgacagcaagcaagctatttaaactttccatgcctcagtttcctcatgtaaaagtgacctaatttttgcttcctcaaggggtttagctagagactgaaataatctaggcaaagctcttagaatactttcagaaataacataaatattaactattaattattaactaatggtcaacaaatattgactattagtaattcttactatgcctttataagcccaaaatgtctaggtccaccatatgattgaaaagcatttgattacatttgaaaatccccaaccaatatagaggtgctttagaaattcacaaaggacacaatgttggtaatgtgactgatgccatacttgaaagaactagaaagcaaagtgattgtgatggtctgaaaggaggggataaactaggacaaggacaatatattattattattttttaaattttttaaacttttaagttcaggcgtacatgtgcaggtttgttatataagtaaacttgtttcatggggggttgttacacagattatttcatcacccaagtattaagtctagtacctatgaggtatttttcctgatcctctccctcctcccaccctgtaccctatgataagtcccagtgtgtgttattcccctccatgtatgcatgtgttctcatcatttagcttctacttataagtgagaatatgtagtgcttagttttctgttactgtgttaatttgctaaggataatgtcctccagctccattcatgtccctggaaaggatgtgatctcatttttattttttatggctgcatagtattccatggtatatatatatatatatatatatatatatatatatatatatatatatatatatatatggcatattttctttatccagtcaattgataggcatttgggttgattcatgtctttgctattgtacataatgctgcaatgaacatacatgtgcatatgtctttataatagagcaatttatattttttgtaatgtatacccccagtaatggcatttctgggtcaaatggtatttctgtttatatgtctctgaggaaatgccacactctcttccacaatggctaaactaatttatactcccaccaacagcgtataagtaagtgttctttttctccattacgttatcagcatctgttattttttgactttttaacaatagccattctgactgctatgagatgatatctcattgtggttttgattagcatttctctactgattagtgatattgagctttttgccatatgatggttgaccacatgtatttcttctttcgaaaactgtctgttcatgtcctttgcaaatgttttaacgaagttacttgtttttttcttgttcatttgtttaagttatttatagatgctgcatattagatcttcattagatgcatagttcccaaaactgtctcccattctgtaggttgtctgctcactctgttaatagtttcctttgttgtgcagaagtgctttagatcccatttgtcaagttttgcttttgttgcaactgtttttggtgtctttgtcataaaatctttgcccattcctgtgtcctaaatggtattgcctaggtcgtcttccagggtttttattgtttggggttttacatttaagtctttaatccatcttgtgttggcttttgaatatggtgtaaggaagaagtccagtttcagtcttctgcatatggctagctagttatcccagcaccatttattgaatagggaatcctttccccattgcttgtttttggcagatttgctaagtatcagatagttgtagatgtgtggccttatttctgggatcttctattccgttccgttggtctatatgactgcttttgtacctgtacaatgctgttttggttactgtagtcttgtagtatagtttgaagtcagatagcgtgacacatccagctttgttctttttgcttagtattgccttggctatttgggctctttttggttccatatgagttttaaaatagtgtttttctagttttgtgaagaaatttaataatagtttcatagaaatagcattaaatctataaattgctttgggcagtatgccattttaatggtattaattctacctattcatgagcgtagaatgttttttccatttgtttgtgtcatctctgatttctttgagcagtgttttgtggttctcctcatagagatctttctctctagttaactgtattcctaggtattttattctttttgtggcagttgtgaataggattacatttctgatttggtttcggcttgacttttgttgatgtatagaaatgctagtgatttttgcacactgattttgtatcctgagactttgctgaagttgtttatcagcttaagaagctttggggctgaaactatggatcagatatggacagatataggattatgtcatctgtaaacagggatagttttacttcctctcttcctatttggatgccctttctttctttctcttgccaaattgctctggccagaacttccaagaataggattggtgagagaaggcattcgtgttttgtgctgatgttcaaggggaatgcttccagcttcaggacaatacattttagccctttttattcatcaagaatgttttcatatcaagtcccagggatgcaacttgtgggcaaaaaaaggaaagagaatatgtggggaagagggagagaaagagagaggaaaggaaagagaaagaaaggaaggaaggagaaaggaagataggaaggaagggaaaaaagaggaagggaagcagagaaaggaagaagggaaggaaggagggaaagaaaggagggcagaaagcaaggaaggagggaaaggaggagggaagaaaccaaggatggagagaaggagaaggggagggatggagggaagaagaaaagaaggaaagaagaaaggaaacaaagaaggaattggtttatgggaccatccccagatttccagcatggctagatacaggttctaatggaacattgcctttgcatccatcactttaccttgctatgtaccttctgggtcgagtttgttcctacagtctcatttaagcttcaaacttgtatgatttttacaattaccaatgtcagtggaaagaaaatgcttccttttgagagtttcaacagtatttctagctctgggtctctctgtcatgggctttcttcatgagcccatccctgaatcaattactgtgtctgaatcaatccttgtgaattatctctgaattaatcactgagtacaataatttggcaagggcggacatgctgaattagaaattgtacaacataattaaaactccataacataattttcaaaagaaataagatccaattgcatgcatatatcgtatttttactgtcattactatcattacccagttatgttgttttaaattttcagttacgttgttaacaaaattgcataggaagcatttttttttaaatggtgtagcttttcacttaagcctgtatccctaaaagctagaatgttaatcaaagaatagaaacacttttgtcggtcttaatatttatggtttgtgacctattcctttgttcatttattaccagtaaagtttttctcacttgtaatgttcttttaaaaatgttaaacattgttctgcgatatgtgttgcaccgtattttctctattttgtcatttgcttttcaattttgcttatggtggttttcttgtaaaaaatgttaaaaattttacatagtcaaatttattagtttttttctttagtacttgcctcttgtattatgcttagaaaggccattttcatgaaaagatattcacaataattgatctgtgttttttcccaatatgtttatggcttcatttagtgtttgcctttttgataatctgggattcttgtgagagaaaagaacaattatgccagcataattatcgtcattctttctccgtcaattcaaaatgtcagctttagtgcttgtatgcacacatatgcacatgcatatgtacacacatgcatgcatacacacacacgtacagtggcttccccattctcctactgcttctgaggttatctttaattagacatagtgatgcagctgaatattatatccttcccaaaccaatgaagtatttgaaggaaatgttttgctttcttttcctcttatatttgcaatctccacgttaaatattctgtaacttttgtccataacatttttgttactcagtaatttaatcatacaaattgctgttttgattccataaatctcaaaaaggaaataaatcttcagcaaagtccttatatttgccacagctttattttcatacatttttctgtgttctgcatctgcactgtggactgtgacttttagaaatgtaaaaagtcttgtcacgtgtaatacttatttttcttactgatagagttactttgagttttgcatgttcaccattccttcatgtttaactaatttctgcagttgactttacctttttttgttttaaaagcttcgttgtgatataattaacaggcattaactgtcacatatataaaggtgataattttttaaatcttaccacatgtatacacttatgaaaccatcagcacaaccaagataaagaccttttaatcacccctgccaaattttaaatgttttgaaaacaacatgaatgaatatatatatgtgtatatatatgtgaatatatgtgtatatatatgtgaatatatatgtgtatatatatgtgaatatatatgtgtatatatatgtgaatatatatatgtatattttcttctcagtctggaagagttttggtttctgagagtctttgacacttgttaaagaagtttaacccattcacttttttctcataacaatataacatattttacattgcatttccatctgtatgcttttatctccatttttaatttttgtaggtacatggtaggtatatatatttgtgaggtatatgaaatattttgatataggcatacagtatgtaataatcatatcagggtaaatggaatatccatcacctcaaacatttatccttactttgtgttacaaacaatccagttaaacttttagttattttaaaatgtacaataaattattgttgactgtcgtcatgctgctttgctatcagatactagattttattcattctatcattatattcctgtaccaattaatcattccaactcctctccccaccattacccttcccagcctttggtaaccatcattctactctgtatctccatgagttcagttgttttaatttttggctttcacaaataagtgagaacatgcaaaatttgtctttctgtgcctggcttatttcacttagtaacttacagttccatctatgttgtaaatgacaggatctcattctttttaatggctgaatagtactccattgtatatatgtgccatgtttactatgaagctgctaaaggaaaacattaggaaaacccataggatgttagactgcacaaagatttcttgagtgacacaccacaagcacaggtacatacctactagagggattgctggataatatggtagttctatttttaagttttgaggaacttccaaactgatctccatagtggttgtactgatttacattcccatgaacattgtacaagagttcccttttctccacatcccacaagcatttgctattggctatcttttggataaaaaccatcttaactggggcaagatgatattttattgtagttttgatttgcatttatctgacaatccatgatgttaagcaccttttcatatacctgtttgcaatttggatttcttcttttgataaatgtctgttaagatcttttgcccatcttttaatcagattattagattttttttttacagagttatttcagctccttctatattctggttattaatcccttgacagaaggattgtttgcaaatatgttctcccattctgtgggtcatctcttcactttgttgattgttccctttgctgtacagaagctttttaacttaatgtgatcccatttgtccatttttgctttggtttcctgtgcttatggggcattacttaagaaatctttgcccagtccagtgtccaagggagttttcccaaagttttcctttagtagatttatattttgagatcttaaaggctttaatctattttgatttgatttttgtatatggtgagagataaagatttagttttattctctggcatattaatatccaattttcccagcaccattgactaaagagactgtcctttccccaatgtgtgttttggcacctttgtcaaaaatgaattcaccgtagatgtatagatttatttctaggtcctgtattctgttccactgatctatgtttctgtttttatgccagtaccatgctgttttggttagtataactctatagtataatttgaagtcaggtaatatgatgcttccagttttgttctttttgctcaggataactgtgactattctggatctcttatggttccacataaaattttagggttgccctttctatttctttgaagaatgtcattgatattttattaggaatttcattgaatctgtagattgctttgggaagtatagacattttaataatattgattcacctaaatttttaaaaatgttaaaaagaatagacagaagtttatctttagggtccctactttagattgtcaactcccttaatatgattccaaatctccttaattgtaaagatttttaattaataattggtcatattgttctcaagaaccgattgaggaacagtgtaacatactttgcttatgtttgaatatattatatatccacctttccttagtatgtaagactaaaaggtttcaaaaggaaaatgatggtagtctggatattattggtgaattcatgctggtttctagtgatcacatttttacttacctcccaaacatctccttagaaattaactgtagcttttgaccctgatcgacattaggctcacccttctggagtgttcacaattaatttatcttcttttaggaaaatatacccaattgcttatattaaattttacatgaaaaaaaggaactttaattatgatctgtaaaatgtaaataatatcagcctcatatattttagatattctttgaaagctggattttggaacatgaaagctgaaatacaattatgtcttcagcacatattgtatattgtagaaatatatccaagttcaacaaagattttaagctaaatctacaatttttaatattttgtggatgtagacttacttcattttatcagaattttgtgttagtaatttttgctttttataatctagaattgcttaattttaatgacaaaatttgaagtgtgattaatagcgctcatggaaaattgtttgaaggatgtactttctattttttttcaattttcaaatatatcttttttagtctatggcaccattaggatgctatgtacttgaaaattataggctttcaatagcgcttacattgcattgtgctcttacattatggatattataaagaaaagacttacatgattgtttatcacacttattgttgcaatttggtaataatattgtcccttaccaatgcattctccctcaattcacaccaacaggaaaatatgagctttgttgggaaatgtttcttttgtaaagtcttacaaacactgcagaatcttatagctagtcttgaatatttattaacaatatacatggctttatgtcacaaactttgtgcggaaaatgatgctttaattgatctaaattgtttattttcattttcttttttttttttttttgagacaaagtctcactccatcgcccaggctggagtgcagtggtgcaatctcggctcactgcaacctccgcctcccaggttcaagcaattctcctgcctcagcctcccgagtagctgggactacagacgcatgccaccacgctcagctaatattcatattttttaatagagacagggtttccttatgttggccaggctggtctcaaactcctgaccctgtgatccacctgccttggcctcccaaagtgcagggtttacaggcgtgagccaccacacccggttattctcatttttattttgactcaatttctgtaatcattccttttttaaatcctattttacttagtcgatctacctcaaattattgaagtagagaagaaatggatggatagataaatagatacatacatagaattatttttgttagcttctaagaccacttagtaaagtctccatgtatacagaaaaagccaagtgaagatacaagcacctacatacaggtccatagcttggaaaggggaaataaaatgaaaggacaaagaaagaagctctaggatttaggcatcaagttgaaggtctgtataatgggcatatcttgaataaaatgtaaaaaccaattaccacagctttgtagcatattcatgtattgacatggtgtcagtacaagaattgtgaaattgtatttgatgtagccatttattttattttatttccataggcatgccactctcaaataaggagatgactaagtggaattaatagcaggtagaatttccaatacgcctcaaatctgattctttaacacttctctgtttctgttttaataatgatagctatcagactgttttgttactcaagagcttcccgatttgtttgtttgttaacatttcaaatgccctgctcaaggtaaacctgctaaataagctaaacctgaacaccatctgggtcttagatatggatcctcaatcaaatgactgtcacttaattattgtactgcttgaacaaattagtgtctcgaaaggaatatgtgaaaatgacacagtttcctttaactgttttattttctcttttctgttatttctcagttttaattgttggatgttacaaagatgcattttgacagattatactctcactacattaagtttattgtatttttgtaaagacacatttggaaataatggaactaagtctcctaattatggaaaaaaatagatttttaaaatatcaattaattttaactatttttgtaaagcttcatatcatattagctgcttggaaataaagatagtgatcagttctttgggcagtttggttttactgtaacaagtctttctccctcacattgtggaagacactaaaccctctagtgtatgctaacgtgtgttttgttagccctggatgcccgcaagagtcattatattcagtaactgaagtctcacacacccttgctcctatttacctcacatgtaccacagatggagtaaatgggcctgcaattccttggggttttaaaaaattcactgttgtagtttagaaattgtggctgcaccattgactttctcctataacagcctggttcagtgtggcatcctagatgtaaagcctgaatagattaaactcatagctttgcttaaaatctctttatggactgttaatcaccaaagcagagaatataatggattgcaaatatttactaggcttgcacttctatatacagctgtgcctagataatttaatcaaggtttgcaaggcaatttatcccgaagagattgggaattctgaatttaaataaggaaaaataaaacagaaaagtattttgcattacagtggttttgattcttggccattaaataaaagggtttccatttatgacataacaggtgaaaacaataaaaacagacttaatgttatccattaaccacatacaattgcatgcttagatttaaagaaaaagtacatgtctacataaatgtgcatggaaactttttccatgtgaaagcagaaaattgacaattctattccgaggaaagaaaagtagaataaaatgaatacaaatcttatggaaattaatgtcatagtttcgttgatgatattttacttggctgatgaacgaagtattcatttcaaatgcacataacatgtaccatattaaactaataaaaactagtctcacagataagctccttcttcccaaatgtatattgttttatttaatatttttaaatggcctgatgagaatctttataagaagatatttaggcaactgatattgcgctgatttgtattttaacaagtttgcttctttattcagtcattatctgttttgaaaacacatagcctcaaacacaaactagctgtgaaagtgaatcctgcaggaaaaccctgatcaggaaacaaaaggcactaacaataagtcacatgtaaaaacatttactggtggtgatgattaaaattagttctgtagggagaagattattttcatgaaaactcattaagataaaatcagtgtttggaaaacagttgttagaataaactctaatccctttacaaaggcaaagaaactttgtacttggaaagaaaaaaatccatgtgacttttatgatgaaaagctaaatggttggaaactagacagtgtcaatgtaagttcaaatattaagggaaaataaatttaaaagcatacaaactgctatagcagccttatgagacataggctaaatatttaatgactatttctctatctgtagagggacctaggcaccaagtcaaaggtccatataatgggcatatcttgaataaaatgtaaaaaccaattaccatgactttgtagcacatacagcaataaatgtgccaaatcgataagaaaaattcaggttaatttgagctaattatctgttcttacattctagccatttatttaaagtatactgcagaggaatagaggcataatagctattttacaaaggttcttcacatggaaaggaaaaagagactgtgtaattttggcccagggacactctgttaaggctgtaagcaatgagataatcatgggagcagtgaagcttttatgtcacttatttcatgtgccagcgtgtggtgtagtaaacccatgggatcactggtgttgcctacaaaatgaagcccccaggacatttttggggacggttgggaaactatacgaggggctattggatgcttcgttaatattcctatacattcataccaagcttaattttatcacctataaatttacttgccctacctacctacctaaattgcagtagtacatgcaagtaaattatatgcactactgtttagaataaacatggaattaaaaaataaatagatataaactcaaagcagtttaaaaccagaatttattttaaaggttagtctatgaaaaaaatgagtaaagcctcaaaatgtgaacaaacaaataaacacttggggaagggtagaatattttcaaatactgtatgatgtgagtgaaaccatttttagattgtataaatttatttccatgaccttgtaaagcaatctttattctaacatgatattactgtttcaaccatgaatcctaaattcttttggagaatcacaattgcacatattatcttgcatttgtctgtgttttcattagagtcctcagatcgtgtgtccaattattcagctgggaatgtatgttagcatagatattggtaaggaaactaaacttatatttttgtttgccctctgatcattgctttaattccaaagttttaatgccgatctgacttatccatatatatttaaatagggtaaagactatttaagatgggtatttggaacattgtaacttttttgttagcagttttaactgcacttaacattgcctctgctaaattaatattaaactttttaaataggaataagtgggaaaaactacattttaacaccgaaataattaagaaccgtgtcaaatctttccttcttctatttaagctcatgagaactttgtgtgtgtctgtgtgagtgtgtgtgtgtgtgtgtgtgtgtagtctattgattgcctttgaattaaatcctgtgttagtttgtaatgctgagtagactgttaaaaaaggaactaaaataatcttgactaagtatagtcaggggtacaatcattggtattcagttacactgcatttttattctcaagaataagaaaaaggacaaaatcttaaagagcattagataatatgaacattacctttcaactatcagtgactgtagggagtattgctagatagaatatagataaaaataccactgacttgcattcctgtgagcttttctgaggattaatgggaagtcatattgatgaggcattggaaaataaacatatcaaataaagacaatgaaagacagttggctttcttgctggactgcacaactggtagctaggattctttttcaatgagtaaatgagagaaaaaaagaaaaatctttacctataaaaaaaaagatggccagccacagtgactcatgcctgtaatcccagcactttgggaggccaaggccggtagatcacctgaggtcaggagtttgagaccagcctggccaacataggtgaaaccccatctctactaaaaatacaaaaattagctgggcatggtggcgggcacctgtaatctcagctactcaggaggctgaggcagaagaattgttggaacccgggaggcagaggttgcagtgagccgagattgcaccattgcactccagccccagcaacaacagtgagactttgtacaaaaaaaaaaaaaaaaaaaaaaaaaaaaagatatgtcaggtttgaagggaaccaccctaaaagggtaggatggttaggataatgttctagaggctaaagaggaatgactttttgttggatccaggctcaacaaacaaaaccaaaaccactggagtgtcttttctggtataatttatgatatttgggtatggattggtgatatggtttggccatgtccccacacaaatcttatcttgaattgtagctcccataagccgcacattttgtggcagggacctgatgggaggtaattgagtcataaaggcggtttttcccatgctgttctagtgatagtgaataagtcttacaagatctggtggttttataaaggggagttcccctgcacacactgtcttgcgtgccatcatgtaagatgtcttttgctcttccttcaccttctgccatgattgcaaggccttcccagccatgcggaaatgtgagtccattaaacctttttcctctacaaattacccagtctcaagtatgcctttattagcagcatgaaaataaagtaatacaattgagtaattagattatatcagagaattattatttcctaaaatgtgaaatgttatccgtagaagaatatctttatttgtgggtgttgaatgctttaagtattcagggatgaagtgcctgcaccttactgtaaaataatccaacaagaataaaaaaaacaaatatatatattgagagaaatgagcagacatggtaaaatgttaaaaattattgaattgattctaggtggtgattatataaatgatcattgtaatttgttcaacttttctgtgtaattaaagtttttatgataaaaaatggaatgaaatctatagactttgcagaggggcacagaagccaactgaaagtggtctcaatggccaaagctagaaaaatttgagaagcaaaataaagaaagtaatattgattataatccaaagtataaaataaatatcatgaagttatttgtatttacattgatataaataaatgtttggataattgaataactaggggggtacaaataatccattcagaagaattacaaatattgtatgcagatagtctgcccccaaggagggaggcataactccccactttttaggtaggagccgtacatagtgacctccttccaaagggtatagtatgcaagggggaaaaataaagagcaagttttccaaggaacctgataaacactgctttagacaggtgaccaaggtcaaatcaacaattataaatcatgttgatgacatgtacccttgatattatgtagtaaaaatggcccttgacctctgtggtcttcctgccaagaaatcataaccacactgttatcatgagagaaacatcagacaagttcctgtggtggggcagcctaaaaaatacctgaacagcaatcctcaaaactgtgaagaccatcaaaaacaaaaactgagaaactgccacagccaagagaagtataaggagatatgaacccaaaatgtaaatgtggtatgccaaatagagaaaaaccacactggaccagaagaagtacattagggaaaaactaaggaaatctgaaaaaattaggaactttcattaataatatattaatattggttcattaattataacatatgtaccatactgtattagtcttttctcacactactataaagaactacctgagactgggtaatttaggaagaaaagaggtttaactgactcacagttctgcaggcttaaaaggaagcacgactgggaggcctcagaaaactgacaatcatagtgaaagctgaaggagaagcaaagaccttcttcacatggtggtaggagagaaagagagcaaggaagaagtgccacacacttctaaaccatcagctctcatgagaacagcataggggaaatcagtcccataatccagtcacctcccatgaggcctctcctttaacacacggggattacaattcgacatgagatttgcctggggccacaaatccaaatcatatcattctgcccctgacccctcccaaatctcacgtccttctcacattttacaacacaatcatgccttcctagcagtccctcaaagttttaattcattccagcattaacacaaatgtccaagcccaaagtctcatctgagacaaggctattcccttccacctataaacctgtgaaatcaaaaacaagttagttacttcaaagatgcaatgggggtacaggctttggtaaatactcccattccaaaagggagaaattggccaaaacaaatgggctacaggtcctatggaagtacaaaagccagcagggaagtcattaaaacttaaagctcaaaaataaccttctttaattccatgtgtcacatccggggcttgctgatgcaaggactgggcttccagggccgtgggcagctctgcctttgtgactctccagggtacagcccacacagctggttttgtaagttggcattgagttcctgtggtttctccagatgcatagtgcaagctgtcaaaggatctaccattctggggtctggaggatggtggccctcttctcacagttccactaggaagtgccccagtggggactctgtgtagggatccaaccacacattccctttcttacgggcctagttgatgttctccctgagggctctggccctgcagcagacttctgcctggaaatccaggcattttcgtacgtcctctgaaatctgggcagaagttatcaaacttcagctattgccttctacacacaagcagacccaacaccacatggaagctgccaaggtaatatggtttggctctgtgtcctcacccaaatctcatcttgaattgtactgccataattcccacaggttttgggagggacccagtgggagataattgaatcatggaggctggtctttcctgagctgttcttgtggtagtgaataagtctcaggagatctgatggttctacaaggggaagtttccctgcacaaactctctttttgcctgccaccatcctggtaaaatgtgacttgttcctccttgcctcctgacatgattgtgaggcctccccagccacatggaactgtagtccattaaacctctttcttttgtaaattgtccaatgtagggtatgtctttttcagcagcatgaaaatggacaaattcacaggcttggggatgcaccccctaaagcaaaaactggagctgtaccttgttctatcttagccatggctggagctgaggcagctgggatgcaaggcaccatgtcctgaggctgcacagagcagcagccccctgggcctggcccaggaaaccatttttccctgttagacctctgggcttgtgatgggagggactgctgtgaatgtctctgaaatgccctggagacactttccccattgccttggctgttgacatttggctcctctttatttacccacatttctgcagcaggcttgaatttttccccagaaaacgggttcttcttttctaccagatgaccagactacaaattttccaaacttttattctctgctttccttttaaatataagttccagtttcagaccacctctttgtttttacatgtgagcgtaaacttttagaaacaggtcacatcttgaatgctttgctgctaagaaatttttcccaccagataccctatatcatctctctcaacttcaaagttccacagatccctagaggggggaaatgctgccagtttctttgctaaaagcatagcaagagtaacctttactccagatcctcatctctgagaccacctcagcttggacttcattgtctagatcactaatcagcattttggtcaaagccattcaacaagtctctaggaagttccaaactttcccacatctttctatcttctgggcccccaaaatctctcagaagtttcaaactcttccacattttactctcttcttctgagtcctctgaactcttccaggctctgcttattacccactttcaagtaacttccacatttttgggtatctttatagcagtaccccacttctggtaccaattttctgtattagtccattctcacactgctataaagagctacctgggactaaataatttatgaaggaaagaattttaatggactcacagttctgctggcttaacaggaagcatgactggaaagcctctggaaaattacaatcatggcagaaggcaaaagggaagaaaggaccttcttcatatggtggcaggagagagagacagagcaagcaaggaagtgccacatactttgaaaccattaggtctcatgagaactcattcactaccatgaggacaacatgggggaaatttgcccccatgattcaatcacctcccaccagtcccctcctttaacatgtgggtattacaatttcacatgagatttggctaggaccacaaatccaaaccatatcacatgctaatgtaagatgttaatattagggaaaaatgggtgtggaatatataagaatgctctgtattttctactcagtttttctgcaaatctaaaaactgttctagaaaatatagtctaaaaatgtacagacattaaaccagtggttcatttgtaggaatttaccttaaatttacatgaatgtacatagaaatgttgatttcaaaagactggatacaaaataaataactaaaataagatagtaatttaatagattatagtgcaattttattgtgcagtaatcaaaaagtaagttataggttaatattaaaacaaaatagaagtacatgagctattgtagtggggaaaaaggattaccacatttgtatagtataattccaattatcatacaagatatcatttttttaaatgatggcttgacaaagaacacacttttttttttttttttttttttgaaatggagtctcactctgtcatccaggctggagtagagtggcatgaccttggctcattgcaacctctgcctcccgggttcaagcaattctcatgcctcagcctcctgagtagctgggattacaggtgtgcaccaccacacctgtctaattttattgtatttttagtagagacagggtttcaccatgttggccaggctggtcttgaactcctgacatcaagtgatccacctaccttggcctcccaatgtgctggggattacatacagatgtgagccactgtgcctggccagaagtgatattattttctcctggtttgtgctctcacataatcttgatcctggagcatcaatttgtatgtggctggtattactttttttttttttttttttagatggagtctcgctttgttgccaggctggagtgctgtggcatgatctcagctcattgcaaactcctcttcctgggttcaagtgattctcctgcctcagcctcccgagtaggtgggactacaggcacctgccaccatgcccagctaatttttgtatttttagtagagacggggtttcaccatgttggccaggatgttctcaatctcttgacctcatgatctgcccacctcagcctcctaaagtgctgggattacagacgtgaaccagtgcgcccggcctacattttctttatttgatgtggatgactggtgtattagtccattctcatgctgctatgaagaaatgtctgagacttggtaatttataaaggaaattgactcacagttctacatggctggagaggccttgggaaactcacaatcatggaggaagaggacgcagacatgtccttcttcacatagtggtaggaaagagaagaagtgccaagaaaaaggtggaaaaacttcttcccaaaccatcagatcttgtgagaactcattcactatcatgagaaaagcatgagggtaaccaccccatgattcaattacctcccaccgggtccctcccatggcatgtggggataatgagaactactctttaagatgagattttggtgggtacacagtcaaaccttatcattctgcccctagaccctcccacatctcatgtcctcacatttcaaaaccagccatgccctttcagcagtcccccaaagtcttaattcattccagtattaacccagaagtctgagttcaaagtcttatctgagacaaaccaagtcctttctgcctatgaacctgtaatatcaaaagcaagttagttactttctacatacaatgggggtacaggcatcaggtaaatacacctgttccaaatgggagaaattggccaaaataaagggactacaggctctatgcaagtctgaaatttaataggatattcactaaaccttacaatttcaaaatgatctcctttgactccatttctcatatccaagtcaagcggatgcaggaggtggcctcccatggccttggaaagctctgcctctgtggctttgcagggtatagccccctgtcaccactactttcatggttggtgctggcattgagtgtctgtggcttttccaggtgcatggtgcaagctgttggtggatctaccattctgtggtctggaggatggtggccttcttctcacagctccactaggcagtgccccagtggggactctgtgtgggggctctgaccctacgttttccttctgcattgccctagcagaggccatgaggtctccacccctgcaacaaacatcttcccgggcattcaggtgtttccatacatcttctgaattctaggcaaacgttcccaaccctcaattcttatcttctgtgtacccatgccaacaccacatggaagctccaaggctggggcttgcaccttctgaagcaacagcctgagctgtacctttgtgacatgactcctttgtgacatgactggcatggctgggacacagtcttgaggctgcacacagcaggggtgtcttggaccacatctaggaagtcatttttccctcctaggcctccgggcctgtgatgggaggaactgccttgaaggtctctgacacaccttggagacattttccccattgtcttggtgataaacattttgctacttgttatttatgcaaatttctacagccagcttgagtttctccccagaaaatgggattttcttttctatcacattggtaggctacaaatcaaattttccaaacttttatgctctgcttccttttgaacactttgccacttagaaatttcttcttccaggtaccctaaatcatctctctcaacttcaaagttccacagatgtctagggcagggggaaaatgctgccagtttctttactaaagcatagcaagagtgacctttactccagttcctcatctttgtctcagaccgatttggcctggactttgttgttcatatcactattagcattttcgtcaaaaccattcaacaagtctttaggaagttccaaagtttcccacatcttcctgtatactgagccctccaaatctctaggaaattctaaactttcccacattttcctgtgttcttctcagtcctccaaagtgttctatcctctgcctgttacccagttccaaaatcacttccacatttttgggtatccctataacagtatcccacttgaccagtatcaatttattgtgttctcacactgctatgaagaaatacctgagactgggtaatttataaaggaaagaggtttaattgactcacagttctgcagggctagggaggcctcaggaaacttacaatcatggtggaaggggaaacaaacacatccttcttcacatggtggcaggaaggagaagaagtgctgagcaaaagacagaaaagcccttaataaaaccatcagatctgatgagaactcactcactatcatgcgaacagcatggaggtagctgaccccatgattcaatgacttcccactgggtccctcccacaatatttggggattatggggattacaattcaagatgagatttggatggggacacaggcaaaccatatcagctggcaagaatgttaactttttttgaagtacattgttatattttgcaaaaatttaaaaataaatttggattttaattgtggtgtgtcatgatttgtatttcaagtaatattgtttaaaataattgtgtttcaatttaatttaagccacttttgatacaccaacaagtacaattcagatttctataatcaatcaacaattccagatttagtaattagcatgtgtagagtcattgaaaatcatttttgttaatgatcttcaaattgctgctaagtgttcactttatttgaaggctaactcatcattaaagaccaatacaaataaaatgtttctctgtgctgtcagtaaaaatccaaactaatattaaatatttacaatagtttctctaatattttgagtgtatttttagattatttgaatctagaaagatgtgttttcaggtaatagagataaattattttgcttttccttaattaatttgtaaccagaggtataaactctttcaaatatatttacacacacacgcacataaaaattagcaattactctctacctaaatgtctagtataataatgttaaattttaccatattttttaaaaacttaaaaatattccacaggtacacttaaaaatgtttattttctagccccctgcattcagaaatataaaaataacttgaggttgatgtgtatcatgcctgcccaatgtttaattatttttgtaagtatgtatgtaactttacataccattaatcaagtaaatacttttgtggtttttttattttttatttttttttattattattatactttaagttttagggtacatgtgcacaatgtgcaggttagttacatatgtatacatgtgccatgctggtgtgctgcacccattaactcgtcatttagcattaggtatatctcctaatgctatccctcccccgtccccccaccccacaacagtccccagagtgtgatgttccccttcctgatgtaagttgaataattctgtttatttgtgacttcatccgatattatgtatttgagatgtaatcatgtttgtcaacctagtttaaattaatttaggtatattaatatgtaaatatagcatcatatttttatccctactcctttagatgaacagaaaatgcatggtctcatttaatctggaaatataattaataccgttattttctgaggtagtactgaatgcatactagagataagaaaactgaggcttaaaccacttaagtaattggccaacattccagctagtgagtgttgaagcgaagatactaaccatgtagtgacaccagataacaaacacttaatgactaattgcaatgtctttctttgctgagagtttagtaaatgaggtttgataatattgaagtaatgggcattgctagtttatggatttcagaggagtaaagagagagagaattgacagatataacagagcagtatgaggaaagcaaagtagaaggcaatcaaaaataaattacaaatgccataacaaactgaattcttttccttatccacagtgtttatttcctgattgttgacttgtcagttgaacactcaacatgaatttctaaattcaactcacttcagcaaatacccagagtacttattatgtgtctcctgggagccgtgatacagaataataaaaagaactcccactttctgaattcacagtttagctgtggaaacagataactaaaattaaacagttcagaagctagacagagcatgacccatttatatggtgttatgggtcatataactcagtctaaagattaggaaaggactccgaaagcttctaaagaagaaaaattaatatggattgtataggataagtagagataagctagattacaaaggtggtaaggatgtttccagaaagagaaggtatcatcagcaaagacaagcaggtggtctgagattaagcatagcacttggaggaacacagtgtcttaagtgcagggttatgagtgagtgggagaggtgggaaatggtgctcttgcagtcaatgaggataacatgtggaaggttttagacaccctatgaaaatgttgagatatttttctgaacataaaagagaacgatgagacatggtttacctgagatcagatgtttgtcttaaaaatatggttttaggccgggcgcggtggttcacacctgtaatcccagcactttgggaggccaaggcaagcggatcacgaagtcaggaaatccagaccatcctggctaacagggtgaaaccccgtctctactaaagatacaaaaaattagccgggcgtggtggcgggtgcctgtagtcccagctactcaggaggcagaggcaggagaatggcatgaacacgggaggcggagcttccagtgagccgagatcacaacactgcactccagcctgggcgacagagagagactccgtctcaaaaaataaataaaatcaatcaatcaatgaatcaataaaatggatttaatagaagcatgcaccactattgcagagaagtgttctaaaggcaaaaagaccatttctgtggttagtgggcccaaagccaagttaatggaagttgacttgggtaagaaagggcaaacgttgagaaatagagtattgggagttcctatcctaacttactgcacaggggaaatataaacataaacttcttggaaatgcaattgtttctaattccagagtctttcgttttagtgtctatactgagtaccaaagatatatagccagttgctcatttatgttattctctcacatcttatttatacatgaccaaaatggaatgtatattctttctctccaaactgttctttctcctgtatcacctatctttgatgacatagagggaagtgagtgtgattgatattcagtagtagaagtcataccattttaagaatagatatcaagtacctgtagtgtcttatatactgaatgaaacttggctttatttaaattgttttcatgtagatatgatattgacagaaatattagtagaaatggagataagaacgttgaggtgggagcagatatacaatttatttctcctacctaaaggttggtatctataaatactacaaacaatcattagtataatgtagacatttactgacttgtcttgataatgacaaaaaggtttctgtgaaaatgtggcttagagatagatctcaatgcaatagtttctttctaaaatgatttttcaaagctcattacctaatttaataaaagctgttctgtaaagatatatcaataattaaaaaacctagttctcatttcaaactttaactttacatcggacacatcaataaaaatatatttgacatggactaatgtgattctttcttttcttccaaggactctttttgtctgttccttataaaatatatgttactagttaattactacttaagattctttctctttggtggggagaaagccttttataatatattcgtcttttgctaataaacctatttcatagtttaaaatatgaaagtatactttaaaagtgaaagggaaccatggataggataaatggtgtgagggttaaaatggacgatggagggatgtttttattagattagaaatattatatcttacaactgaaaatgcaaattatgctgtgccataatgttcctttcaagcacataagataaaatttgcatatctaaattggatcagactgaataggtttccctggtctctcttccctgaacagcaatcagcctcaaaaagactgtaggcaatcccaatagtgagtttttaaagcccatattcaagaatcttcatgtatgtgtgagtatatgtgtgtaggtttacatatatgcatgtatagatacataggcataaacttacttatatctgatttaattccttagagactgataaaattttctatgttcttttcataattattttccatacacgtttttcattttcctagatctttcaaaatattctttctatctagtgtccacattgctggttgatttttcagagtgtcataaacatttgaaactttgagtttcaaattatctttatgtattagtgagatacgctctctctttcattcacctttaagaaaatatctgaaatatttaataaggaagaataaattatattttactcagatacctgttattcaaaagtatcctacatattattttttaagttcaaatttttattcaaaatatttataattttagtctctttattcatgcaattaaaatatgcaaataatccacaatggaatgtacttaaatttttacatatgtacttaaaatttacatatatagttggtttatttaaattattttcaatgaaataaaaattatagtttcaagaacttgaatcttgttatgattgattacctttaaatttctgaaaatttagataaatggatataatatggaaggttttagatgtattggataatcacattattatcacattattatctgcgcttaaataagcgttccaaatcaaaccacctgactctagatgcttttaataaaaatcagcactagataattgtgagaataaaaataagtccaaggttttaataagccaatagtagtctcatgccattgagtattttaaaaaaatggaaatgtttctattttcttataaaagatgtgcatctattatatttatatacggaagactatatgtttcattcaaatatcatagaattattcctatgatgttcatgcctgattattcatagataaagcgtccagttggtagaaaatccatttagtaaatttctcatttttatttcaatttgtcttttgtcaaatttattatttataattttattggtatttttatttaaaatatcactgattaagagtggatagggtataaatatatttcattttaaatagtcttgttttaatatacaaagggtaagttaataaaaattattccttaaaataatgttttggtttccagtaaagcaataattttataattttaaaaaatctttcagaaaataaaaacatgaaatgcaagaatagagtaacagaactattgttcttgtttaggacgtaattgaaactggacaaaactgaatattttatttctcaattgccctcaccaatgtttttgtaccatagcttctgtcatttttggttttgcagtagttcccactactacctatgtatcctcaagtctcctagctttagtttctacttatacctctcttccatgtaatgaaaggactttataggagtctttgtataaacaaatgggtcaatacttgaagatattaatcctttaaaaggaaaatattctagacaaatggaactttaacatcatattttatagttttatattccacctaagggcaataataatcttggccgggacatatttgttgtatattattaataacaaagatatataatttatatagatagattagtttttagatagatacatattcatatttatatattgcctaattatatagcatatactacttaattttatataaaataagcatatgtgattttaaagatacatatgtatttatatgttttcacatttgtaagtatattgatatacattaagttgtttcagattatttaattcacatattaacttttaactggactgtagctttttgggcacatggagttctcaaatttttccactttcttcagctcagttctaagtaataaacgaatggtcaatactgctgattcattgatttttttgaagaactatgtaggaacaaaatgaaattgacaaaatttaaaatcttatgaaatcaactcttgctggagtaaaattttgtaaataatttggaaaataatttggcaatatctgataaagatgtgcatgctcatgactacctagtagtaccatatagaagtatttaatagagagaaattattgcatgtgtgcacaggaagtgtttacaaagatgttaaagtcagggttgtttttaatagcaaaatactggaatgaatccaaacggcttgccaaaaaatgcgttaagtaacatgtgtcgtgtttattcagtaggttttaaagtgaataaacattatttgttatctatgttaacactgccatgtcttaaaatgtgaccttgagtgaaaaagcaagctatcaaattacgtatatactctgacataatttatattaatttgaaaaccccgaaatacttcatatcactgagaggtactcacgtctgtatgtaaaaatataacatatggattggaaattgtagtacttagggtgcagaagcgtacccttagacaaggctttaagtgcaggtggtttatttaggaggtggttttaagaaacaacagtaggggaatagggaaataaaaagaaaaagggaaaaagccaataaagcatgtgttaccaagtgtatcacaatgatgagcaactagaataagtactatgttgctggagaactctggaagactgtgtgaaacacatgcttttgagatctcacttaagggaccagaggcactagctttgatcggtcactagttaagagctgctgtgggtgagggagagtgacttattgcttgagattttggtgttgcacatggagttggtggactgtagtggttgaagagacccaggcaaagagacacgggtgctggcagctgtgagtcagagctgtggtcagtggggatatgggaagaccataatacctactaaattaatgattgcacttgctgctaggggctagtagatgggaaaggaatgaaactaggcaggcctgcaaaacaaattcaagttatagattttctttaatttttacttaataaaaatatttgatgtaaatatgacaaaatcttaatgattttcaattcttgtagcaggtgcataggtgtttatgatggcacttaaaaaacactttactggccaggcacggtggctcacgcctgtaatcccagctctttgggaggccgaggtgggtggatcacgaggtcaggagactgagactatcctagttaacatggtgaaaccccgtctctactaaaaatacaaaaaaatagctgggcgtggtggtgcacgcctgtagtcccagctactcgggaggctgaggcaggacgatctcttgaacccaggaggcagaggttgcagtgagcccagatcacgccactggactccagcctgggcgacacagtgagactccatctcaaaaacaacaacaacaacaacaacaacaacaacaacaacaacaaacactttcctaaatttcaaaaaaaaatttttttagaagtggaataagcactggtctggcactgctgggctttttattatttggcatgcactgaaaggctgagagtcgagatacagattttgagctcctggagataagatatcatgccattttgtttactaggaaacttacagagaattttggtggaagtttataaaatgaatgaataaattatggattctagttgacaaggccatttctggatagatattctagaccagctatgagtcacactttttggctttagctaccatcagtgtaattgtgtctaatttctctaatgcactttggtattgactgggtgggaaatttactgttcattcttaattgaccttaatatctaatactggcatttaaaaaggtaaggttttggatgatcacagtcatcctccagtacatgtgaatgacaaagttgcagaaaatttaggaggtcagctattgaagagtcttgataggtgttgtgaaagctgattatgccaactggagtcattcatgtcatgcccagctgaaatggagtcagaaggcaatggtgaagggcaaccagttcctattccaagaactctttttgcaattcaattgaaaatcctaactacaacttaaatgttacattttacctagtaactgctgccactcaccaatcaaaatggatcaggtcctgcatgactctgtaggtgaaatttttctgctgaaactttttttcaaacaaattgcataactttcctctttaaccccataaagtctcagcctttctctttgttctttggatacatgtaagggctaccctgacttgtgtcccccgaattgcaattctaattcccacatattattcccaaagaaacactttacttggaggtttgtctttgtttttatttaaggttgacagcgtttagagagagaacagtacatctgtaaagataaggttttctttcatttattactctgagaaaatcatcttaaatgtgattgtaaagactataatctcaatacttgtacagaattgctaaacaacaatatggatatgtgtcttcatcacctttatttttactattacaaaggtaacggtgctgccacacattccctctgaatattaggaaacacactgggatatgtatgagccattgggcaaatgcattccgaagcataaccaggaaatgtcccagcaaactgtcaaacaactttaaagtaactcttaggcaaaatcctgctgcagacaaaccagttcatgctgtttcatgtatcacgaactgaattttatcaaccttacagatagataatcttccatttaccaaaaacgaaaacaatattttgtgagtaataaaatatggggttcctttgttcttttgaagggaataagagccaataacaccaaagtgaaaagatagaaaatactaatacttaaaattatgtagataactatacttcacagaaaatactgtttgaactaaaaacaagaaatgttggttaaatgttgttttctcttctttatgtaattataatgtgaagaattgtagctattctttttttagaatagaaatagctttgtgataacagcaacaggagtaattttagacttgtaaaaatgtgcatttcaagatactgtccaaaaattaagtatggcaaaataaaatttcaaaaatctgcagatcatatagcactttttgtcatatacaatttgcaggtctaaaacttcattcgttgatttgtttagatcctagacaacaagacactcttgcaaaagtaaaggacaaaataccaaccccagtcttactactcatcgacttttgttttaagcggcatgtaatggcagcgtgtttaagattctgcttctgaaatgtgatgtctcaatatcaacattctccaattgcctgttgtgtgagctttacctgattaataaccgtgaggaattctgaagcaaacatcgcagtgtttatcatgtactcctttgcctcagtcttttagtgtggaaataatgatcagggatgatttatgtttgtcacccgataagtgcttacttcatttctccccatttttggtatatttgcagcacatgatttaaagctatcaaagcactagaaagtataaacagaaaatctctacgatgtagatactcagacttcataattttcttgtgtgtacttacatgggttataagtgggagtacctattatacagtgtggagtatatctcatacagttttagagcctaataacacccattcctcaaagaagaaattttgaagagaagacagtcttggctgctatgattcaacaacaaacaacagataaagagtcacagaatcttgtcaaatgaaaagctaaattgttttttaggagtttattgagaagaaattttatgaaccctcagtaaaattttccatcaaaaatgagttcaatattcaaaacatttattattttcctttaagaagaaaacaatgtctatcaaaattgatgcctgcctgtgttttaagtctaataatttttattctctctctctttttagacatcttcttttcatcaattctttatcattttgagagcttttgaggacttttgtacttgataaaactgttaacagtttcttggatttaaaggactacttagtaaagtgccaattagaaattacaggttttgtttttgtttttgtgtatttgtttgtttgttttttaagcttcagcttacttctactttggagaagttttcttttttctcaactttaataaaactcttgtgtaatttttaatttcaattgccaaactcctaagtttcgagtgttatttcatgtgttctgattcttcgtttttatagcatccttgtttctgtttcctgatttcatttttttctgagcatattattgatattttttctttcattattttatctgatcccttcattttttaaaaacatgtgtatgtatatgtcttggcatctgtctttagttttagaggcttttcaacgaattatgtattgagatttgagaaggaagtactaaaaatcaaattggatactcaataagcataggtaaatgttgttcgttgaaaatctatctgttcttttctttggggctggtgggattcctcaatcaagtattgtggagttttcctcttgaaaaatatatcccctgcttccagcattctgagagctatatgaaaggaaagaatagagggtttctaattcagtatgcaactatccattctgtctacccatttcagaagagttcctcacctccacactcagctttgtgtggtgtctccgtatctccctgccttaacttctgagagtaacttcaagtttcctacagaggggaggaagagtagtagtaatccgtttctgactttttaaactataaagagagttctgaaaatatgaaacattttctatacatagcatagcaagttcaatgcatgtctaacaagtcaatattctaaattacattattcgaataaacatacaagtaaactttaattcaatggtcaaagactgagggtattgttttccttatcccatgttatgtttattatttgtatgagtggacctcatttcactaattgttttgcagaaattatcacaagactttttaaaatgaagactccttttctaatttggggagtttttttctaacttttctaaatgtgattacttcttctgctccagttatttgtgttttctcctctggaatgccgattatacctactttggctccataccatctagctcccatctttatcatcactttggtcactgaatttcagttaggacctttctcatagcattttccatatgattctttcatttgtcctctggaccacacattttgtttgtgcattgttaattctacttactgttccaatatgaatttttaattatgctattatttaattttagagtttttttcgtttttaaatagctttatttccccatcatacaaatggtatttgcctatttgaggacaaaattcaaatatcatttcaggacaaaaaattaaaaagaaatgtcttttatatcttgcatattaaatattcaggagaaacctctgaaggatttgacagaattaaggctatattgcccttttagtcttgatgacaactgtcaacctgaaaaaaagtttctaccttgctaggatttcatgtatagagtgtgagatgcagacttctcaatagcattgtgtatagtagcatgtggctactcctgaaactgggggataatagcggggctaaccatttatgcaagagatggaataagataagttactgtagaatctgagaatggtgcttcttcaccaggaggattgctggacagacaaacatgtaggtactctgttagatattattcaacatattaatttgggctaatataatacattaaaaattggctactcattactattttaaatgttattttttaaaagttatgattaagattaaacattttttcatgtctcttggccaatcatatatcattttcagtgaattgcctatccataaacttttactttctaataatattttttaaatttttgtcttaatatattataggttttatatgttaacaattaaggaaagtatagcaaaagcattttccaattttttgtcatatgatattatttttggtgagttatcttattaactatatgggacaaataattatgaagaaaccatctgccttcttcatggcttctgaatatttgactttcttagacaggctttttcaccccagatttgtaaacatattctcccacattttattttgatatttttacaatttcattttttttcacaattgtctctttgatgcatctgtaatttttattaaattgtgaggagaaattcattgttcttgttttgcaatggatcacaatttgtccaaaacattccctgttttctttattttttctttactaatttgaaatgcccctattttcatgttctcaacttttccataaactttggtttgtttcaagacttctgttcaataacttgtctacagctccacagctttacatagctccagttgtgccattatcatgttgtaactgaaatggtgtttaccaagtagatttagattccttctttatcacattgactgttttcacaagtctatatttccatagaaatgttagagtccatttgtttggtttagaaatatccttctgtgtattttactaccacttaataacaaggattaatgtaaaaaaatttatgtatataaaatggattaatgaacatatgaaataatttagagaaaatgagctgtttacatttaaataggtaaatattttatttagttatctccctttggagaattcaaaaattttatataggtcttatatacacttattaattcctaagtatgtttagcctgtctcatttatcaattataaatggaaattctaacctattattcttaattttcagaaaagtggttgatttctgttttaaacatgatattttctgaatttttaaatttgcatacaatatttttctattgatatctttgagtttcatagatatgtgatgttgtaattttcaattagcagttatttttactcccttttctaatatttatccatcttatttctttctcttgtctaactacatgtactcgtactaatagaataatgttaaatttcatggcaatagtggcatttctgtcttgttcaataatttagtaagaatacatttgaatgttttatataagaaaaatataactactttgacgtgatcatgataggaatcatgactcttatcatttataaaaatattgatctattcttattttaatttttttcataagaaatgttatcaaatttatttttagtgtgttatgatagttacaaagtatcttcttttcccgtgaatatgggaaaatatatagtataaatcctaatatctagccatccttgcattctgggcgtgattctaaataatattattgtttattctatttctctattatatatctgaattagccaatattttatgtcaaaattttgcattaatatttactagtgaaattaacttgcgattttattttgtggttatatttcagttattattgtatatcttagtattgtgctagcttcaatgagacaagataaaccgctacaacttcaaatcacattttaataactctatatgtgaattattaaattttaaataaacttatcaaagaagaaaaataatatgcattatctaaagacttcgaacagagtacaacattaaaaaacaattaaatagcacagttcttataaaactgaataaaacattctcattaaaaatgatggcatttggggacatggcaggccaacaccattttttcagagaccttgttgatgccaggcttgggaaaattaaaggcaagatgactttggcaaacatcgacatagctctttgctatcccctccccctcctcatccagcatcacatcaggatgttctcctcagtcaggatgatttgtctgtattgctttatttaaaacaaatttatttccatgagtcaagcataatgtgttgggacagtatgcttcataaagttgtatgttgatttgtttaatttcaaatagtagagagataggctacttcactaatatataaaaaataatgagtttggtgatatttattattttatagaggataaaatgatacttatatcttgctatgctttatcctttcactggtgcacaatgagattaatcttctgtcactacatataaaaaaaggcaattcctcttttattgtcacttaactgcttctgcacaaaagccatcatccttttataagaaacctcaataatttgtcactggtatcaccaattctaagctagttattaaactatttcaataccatgatattcttagtaattgctgtcgtttcctaattatattctcttaaaagggtttgatccactatgaacttttcaaataaaagtgttgctaaggcaactaaatgtgatttgcaacaaaaatgaactctcactgcaacaggatatttcaatgaacacttccttttttttaaacctcctttgaattcaaatttgctaaaggaaataaatacacctttgaacctaatagaaccaacacaggcagtaatgggatttcattaaaaaggaaaaaatctacaatgttaaagttgaatacttgacaaacaaaaaggaaagagggtttacttgaaaggtactagtaggagaaaatgagttctatgtctctacctcactgtgaaatatcaattaatattttaaatagtacaaagtataacatcttgaacctaatctaagttatttactgagcaaaataatttagacacctccctggatactcaggggtgtaaagaacacacataattagataaatacttattataaaaagttgagtaaaattaagcaatgttctttgacaaactattttactctttgaatttcatactctttgaattcaactctgtttttgttaagttctcttttattgttttttcagtaatcttcaggtaattttcattactttcattacatttgctaactgggctggcatctagattaaccaagtgcagcttagtagagctcctattctacaaggtgagtttacatttcaaaattgtgctcagagttgacaattctgaagataaaactcacattccaaaaagtgctaaacatcttgatgacttaaatagtctccacgtgagaataatttcttaggtctttaaagcattcctcatgtcacaagcaaataataggataacataaatctgttaacatacagggttaaaattggtgttatagaatgaaacaatttgatgattatggttccatcatctgttttccagtaatgccgtagatttaaatacagactacaagtttaaaccttttaaactttgtgtttacctaattattccagagactttatttatttatttatttatttatttatttatttatttatgagactgagtctcactctgttgcccaggctggagtgcagtggtgcaatctgggctcactgcaagctccgtctctcgggttcacacttttctcctgcctcagcctcctgagtagctgggactacaggcacccgccaccatgcccggctaattttttgtattttcagtagagatggggtttcaccgtgtccagagacattttagaggaataatttatctatagcatcagggtcaaagcagttgagggaatcctgcagggaagtagatttgtcaaaccactggtatccggaatggtaagaggctaaatgggtctgtgtaattcagcgaagatgacaacttaagtttcctgcagccttgtagagatatgaaagttaagagtctaatttcagagcagtatgcactcatgacctttttgttgcacagtgaactctgattaacgctttcacccaaggtactaaaataatcattaactcaatcagaatcttaactaaaatatagacaattgaatgaacttcttaatgcagattttcctggtgttaaagatcagcctcctaattggaagaaattataatagtttctctgttgttgctattaccaaatgacttcaatacaatttgatttgtgggatttaattaccatattcgtattatctcactaaaagaagtatagaaaaatctgctaattagttttctaataaatgttcttctattagactaacaaaagatcttcaaaagttcaggatgttttgggcaggaaggatagaccactatcattctggtagccaaagccaacaattacattattttgcccaaattatgattagaaacaaatatttgataaattatccacataaatacatattttaatggaaaccgacaaattaaattaatcaattaaaataagtaagtcttccatccctagatttcaaaaataacattctttgtgataatctctgggtcactatcgttattagagaattaagattacaaaaatgttaattaaacacaaagtaaccactatacccgaagacctgagataacttgggtattctgtgattatctttgttgaaacacagacttggtgttttgcaaagaaatcatttgttctgccttagtgaagctaattattctcagcatgcaaccactgtttcaaattgcaaaaggcacatcagcctttgctgtatgttgcaggaattaaaacccaatcaaatgagataatgaagtgcatacaaagaatatgatctcactttcgcaatgcaataaaagtgaaagcgatttaaataaatgttgcaaaaaatcataatttacacagagaaaacatgctgtaaagcaaatgtttactatttaagtacttactgcttagaggtaagcattaggtttatttattatgtggttaagatacttcattttaatgactgaagaatatggtgctaacagtccaatatgaagattaatataaagcaggtttttaaaaaaattcatggtaaactaaggaattagactatattatgtcagggataaacatatacacttaacaggaatttcgtgagaatatattaagtaaatggttaaaatgaaccagcatcggtactcttctgtacttgtataatctaaaagaatgaaatacatcagtgctcttactcattacaaaagttctttgctaatgtctgccacaacttatcatccatttaaaaaatctctacttacttttttttctgtgaaacatgttttgttttacctaaggagaaataatccattagtagcccccatgattgcataagctggtgaaatataattggatctggttctatgttccattttactgaagataaatttcttgtaatttaaacccattgagttaatatttttttattgtttgctttcggtttttgttttcttccatactagccattatcagtgatgcttcctattatctacacaccaataccatctttcaagttacatggggtgaaattaagatggattataggttttgtcttttgcttgttatggaagaaaccgtagcaagcttccctttcagctgccaaaaatatacagtcatctcagcagcccagaatgtgaaaacagcaggattcaaacatcagcaatgacaacacagagagcatgaagtttctgctcattacacactgtgggggctgcctatctggaggagtttactctgcaaagtattgatcgaggataatgctcactgttagtttatttacatatcaatgtgatatcctgggtattaatacattagtgggcttttctcttgattctgtcttctttcttcatattacattttatctttgtttacaaatgtcagtcatatatatcgcattgtcctagagtggaagaatatgtttggctagcatgtaatgttttcaagctcagtgtcatgcattcatgaaggctcagtgaatgatgcatgttatataaaagtccctctgtctgcagaatttgacacagtgtttggcacataatagatactgtaaaagtgttttccattggttgaataaatgagcacattttcactgaaggcttgataggagagacataataaggatcatataagaactatgataaaataaatggatattataaacttttccacaaccattgggtcagaactcagtaaacactgggaagagctcagatctagatttttaaaatgcacaattttgatggtgttactcttaagttagtgttagattcctatttttaatttggactaaaaatttaacaattttagaacattcagacagttgcaagatgtggtttctctcacttttcccttagaaacacacgtgtttataaggaattttgacagcagtctcaactcatttacattgagcactcacaacgatttggaagtgaaacacgttatggtttaaatagtactgcctgccaacagttttgaagaactgcttttattcacatccctacttagctgcttatgttcatctcttcttagttgagtcaagtaaacttagatggtgagctattgttcagccaacttggcgtcttttaacccgacattcaacttagaaagaaaagagttgttttaaataccttttaccccttttttatcaacttctgaaatctattgcaacatgttctgtgccttattagcaaatgaaagaaaaactattttctttgtaaattgcaaaacagtatattgtcatgtgccaagacaagtttgcatctgtatctcaaggggaaaaacttttggaagtggcagatctaccagcagcaattaattagaaagcttttcatgttattttcagtaacagtcatgtattagcagcttgagaaaattgctagcaatgggtgctgtcaacataggattagcacaatggatggagttaatttactaacatttgcttttcttctcaaattttcatatctttatcttataatgaggttggttttcattgccaaatggtgaagtcagcgtaaatacagatttttaattgaattatgaagcatagagtgtgagctgtaagcatatcttagtccacaagagtgaatacatcttatacttgtaaatgataagatatagtgcacagctggtctctgttcaccaccccatatgcagaaatataaggaaggccagtctcttaaaaggcaaagaagaatcaatttaaaatattagtagcaagcctgccaaaattatttgtcaatttttctagaataaatataacttttataaattaaattatatgccaaaggaaagctttacttttttagttcatttatgggtaattatatatgccaagatgcattactctcctaggaaattgttgtccttgaattcatcatatttatcatgtctggaataatggggcacagttgtttctcttcctttctgattagtaaatagaaaaccagttcttttaaaattttaggcatgtgaattgttgattcaaattattttcctcttttcacaagtatttgtcttttacctattgtggactttgtactcctttaagcaaatttaaattcggcaaatattatgtttattatttttttcaataaagacgttatttacagaatcactgattttcagaagctgtccccagttaagacaactctatgtacagagaactcatggtgttccactacttccaaactcatcattaactacatggaaaagttgttaaacttgtgtatcttaatttttttcatttgtcacataatagtatcattcccacttatttcatctgattattataggtttaactgatactttatgtgtgaaagtaatgaacaccagtcaactaaatgttaaacattttgcttttatatttgattttaaaaaatacaagaaaatagaaaataaaacataaactctcaattaagtaagttgaacataagaattatctctgctttagttcgaagccccagctaaacatcaacaggggaatttaaaatgtatgaatgcataaagccaaatagaacaagagaggctctaatacaataagtggtatcaaaaaagtttatttaaacaattaaaaatccaatcaagagaaaactgttttaaataactcagcaaaatggaggaagttgagaccataaatgcctcaaagagtatagcaaaaatattcacccagaagacctaaattcagaggcattttatactctgaaggtgaggtataaagcaaggctatcaagctgcacaatccaaggaaagctattcattttgtgaataatagctaagggcttatgaagttaagtgtgataaccttttattcaaacctgagtctgaatatagagttttaaaagggtaatgcaacatgaaacttcagtttacctctttcattaagggcacatattttcccctttctatgatctgattgctctagcctccctccattatgaatttgctttcttatttgattggagttgagccctaataaaggtccatcattattgactaaattcctgctagctctctggataattaaatccaatttttatattcagtgatttctaatccacttttgtctacctaaaggcctaacaatttgacttgaaaacatgacgagggttaggcctggcgtggtggctcacgcctgtaatcccagcactttgggaggccgagatgggcagaacaaaaggtcaggagttggagaccagcctggccaatatggtgaaaccctgtctctagtaaaaatacaaaacttagctgagcgtggtggcgggcgcctatagtcccagctactcgggaggctgaggcaggagaattgcttgaacccaggaggcggaggttgcagtgagccaagattgcaccactgcactccagcctgggcaatggagcgagactctgtgtccaaaaaaaaagaaaaaaaaaaagataaaacatgtggggggttgtgatattatgatattcaggtaagcagacaaaaacagacaaaaccccaaaaccccataagcctcttaggtgacacaattacctgaatatagaaatttatggaagagttaatgctaatgttttatcaaatccattttattttcttcataataggtatataaggagataagtttaccaatttcctttgtaattagattggggccatataatatcattttgccaaaggtctatatagaaagataatataaacatctgatatagctctcttgccctattcttcttttcagtggcaaccacatagaccacattttgagatatgaagccaaaaggtgaaagtagccgtgactccttggagggtagaacagatgactaagtaaatttgaacatatatcaatagaaaatatttaatcggatgaatttagaggagaaaaaagataaaatgagcctcaatgatgtgtgagtcaacatcaagcatttcaacaagcaggtcatggaagtcccaaaaatagaaaagagagaagggggcaggaaaaaacatattttaacaaatagtgttcaaaaatctcacaaatttgatgagaaatatgaatgtaatcacttaaacataaaaaaaacccagagtagaatagattcccatcacctagaataagaaaatagcataaggcatcaagggaaaaatgactcatcaagtgcaaggcaaccacattaatataaatagctaacttatgatcaggaacagtagatgtcagaagacagtggaagctcatactcaaaatacttaaagacaaaaaagttgtcaaccaagaaatatttatctaacaagacaatccttcaaaaatgacgaggaaataaagaaattgccagataagcaatgtctgagaaaattcattcccagcagacctacttatatgaaatactaaatggaaacctataggtctggaaggaagtgaaaccagacagtaactctacccacagaaataaatatagagcatcagaaatggtatgtttagtacacataaaatattttataaatttatattttctcttaacatctctaaaagatataagattttatgcagcaatatttataacacttttttgttaaggttataacatacagatcacattacagagaggaggaaaaggagtgatagtgggcaataattctctatcttataggaataagttaataatattctgaaatggctgtgaaaggatgacgtagatactgtagtccatagagtaaccattaagaagttcatggctatttaaatataattaaatttttttatttccaaagggtaaaaatggtatgctaaaaagtacaaaataaggtataaaagaggaaaagaggaacaaaacagttaagatatgtaaatagatattcatagcagcactattcataataaccaaacagtagaaacaacccaaatgcacatcaactgacaaatggataaagaaaatttggtttacccatacaataaaatattagtcagccttaaaaagcaatgcagtgctgatttttgttacactattaatgaaccttaaaaacttacgctacatgaaagaagccattcacaaaggccacatattatataattcaatctatataaaatgtccaggtaaatccgcagagatagaaattggattaacgattgttgcagtctggggcaaagggagaatgggagtaactgataataagtttggaatttctttttgtttcaatggaaaagtactaaaattatacgatggtgatgattatgcaactctgtgaataagacagtaaattgtatatcctaaacaaaattatatctaagtcaacctgttatttaaaaattatataaaacaaatagagagtaaagaacaaaatgatagatgtacgtctaaccatataaataatcacattaaatgtgaacgaactatggggaaggtgggatcctccaacaattgtgtttccacaaaaacatcaatttgaaacactatccataaatgaaaatacctccacaagtgcaaaaaaatacaggggaagggttacaacacctggatgaagcatagaaataagaaaagacatattgcagaggttaggaaggatagttttacattacttacagtaccccttcacaaccccaggcagcattgtgtagagagaagcattgtccactttggagagaggaaaatgagcccaggactttgccttggaccacaatacctgagccaccagaataaagcttagcatttggcaggctcccatggttccagactccaggccaatacctgcaaactgagtttccacatccaccccaacaccagataagaccccacagccccagacttcaggcctgcacagagaactttatctccagtttgcatcactgctgaactgacttcagctacccctggtttcacatgtctcacagtgtcagaactccccagtggctccaggctctgggcctgcctcagcaacttgccagttccagtgggcatgggcttcagaccaattccaagggataaaagcttaggcccacatggatccaggctccagatctgcctacctgctggcctaggcaccagtccagctagccctgactccagcaagaagccttttcatgggccacatcacacaatctgactagactctatgaatgagctgttgaagggcttttctggacaaagccagtctgcaaaagctggaatatgtacctacttcttcaaatgatcagacaccaacaactgaccacaaagaccaagaacaatcagagaaacatgacatcaccaaagggacaaaccagtggctgaccttaaggaaatggagatctatgaactgcctgacagaaattcaaaataactgttttaagtaacctcagtgaaattcaagagaatacagagaaacaattcaatgaaatgaaaaattaaataaatggccagaatgataaattcagcagaaagattgaaataataatttttaaaaatataaattctggctaaaaattataatgaataaaattaaaagtgccatagaaagcatcaacagcaaaactgttgaaacagaagaaagaacctatacactgaaagacagtctatttgaaaatgtacagtcagaggtgaaaaaagaaaaaagaaatgaagaaagcctatgggatttttgagacaatatcaaataataaccttattaatctgtgttgttcaagagagagaaggtaaaaatccaggggtagaaagcatatttaaagaaacaaaggcagaaaatctttaaacctagagaaacttacaaatatccagatacaagaatgtggtacaggaaggtcaaaggtctcctatcaggttaaatataaacaggacgactcccaaaacatattataatcaaactgtcaaaaatcaaagataaagcatcctgaaagctgcaaaagaaaagaaaaaaaaaacttatatcagagtttcagtataactagcaagagatttataagcagatagcttataggccaggaggaagtgggataatatattgaaagtattaaggaaaaaactgctaatcaagaatactgtgattagaaaatttatcttcagatgtgaagtataggtatataattcaacagacaaaccaaagctgagggagttcatcacagccagacttgtcctataagaaatgccaaagagagttatataagtgaaagaacagaacactaatgagtaacatgaaaacatctaaaagtacaaaattttctggtaaaatacatagtcaaattcagaatactctgatattgtaacagttgtgtgtaaatcatttatatctttagtacgacagttaaaagacaaaagtattagaaagtagtaatagtatcaataaattttaggacatatgcattttaaaaatacataaattataggtcgggtgcggtagctcacacctgtaatcccagcactttgggaggctgaagctggcagatcatgaagtcaagagatggagactattctggccaacatagtgaaaacctgtctctactaaaaatacaaaaattagctgggcacggtgacacttgcctgtagacccaactacttgggaggctgaggcaggagaatcgcttgaacccgggaggtggaggttgcagtgagctgagattgtgccactgcattccagcctggtgacagaccgagactccgtctcaaaaataaatatatatatatatatatacacacacacacacacacacacacacgtataaacatatgtatatacatagaaagcgtatatacatatataaattgtgacagttttaaaaaatcaaaattgggggtagattaaaagtatacttttttgtttggtttggtttggtttgcaatcaaagttgttctcagcttgaaaaacttttttgtaagcctggtagttaccagaaaccaacaatttatagtagatgcactaaaaataaaaagtaaggcatcaaggaatatcactaatgaaaataatttaaccataatgggagacagcaagagatgaggaagggaattaatgatctatgaaacacctagaaaacaattttggcagtagtaagttcttacctatcaaaaattaccttgaatgtaaatcgattaaactttccaatcaaagggcatagaatgtttgagtgcgtaatataacaaatcccaactatatgcgtcttaaggatacacatatgttgagtaaagagatggaaaagatatttcttgcaaataaaaacaaaaaaagagcaggagtaactatacctgtatcagataaaatagatgttaagtcaaaactgtaaaaagaaacaaagagaaaatgaaggttattatataatgataaaaacctcagttcagcaagaggatataataattgtaaatatatatgcactcaacattggagcacctaaatatgtaaatcaaatattaatatagccgagagagactacaataaaattaaagtaggggccttcagcaccccactttcagcaatggacacattatccagacagaaaatcaataagaaaacactggacttaaactatactctagcctgaatggacctaacagacataaacaaaacattccacccagtagctgtagaatacatagtcttctcaagtgcacatggagtactctcccaagacagatcatgttatgccagaaaatgagtcttaacaaacttaagaagatttaaataatatcaagtgtcttttctgactacaatggaataaagagaaaacaataatataaagaacgtttaaaatttttaaatacatggaaattaaacaacacattcctgaacaattgagtcaatgaagacattagaagggaaattaaagaaacttgagacaaatgaaaatggaaatggaacatactaaatctcataggatttggcaaaagtagtcctaagagggaagtttatagttgagtataatgttagctatgggtttgtcatatatataacatatatgtgtttatttcattgagatatgttccttctatacctaatttgttgacagtttttatcatgacaagatgttgattttatcaaatgctgttttctatatctttttaggtgataatatatttttgaccttcatcttgttgaggtgatatatcgctttattgatttatacatattgagccatcctttcatctctgagataaaacccacttgattgtggtatattatttttgatatgtggttggaattagcttgctattattttgtcaagaatatttgaatctctgtttattagcaatattggcctgtagttttctttcattgttgtgtcattgtctagtttgggtattaagataatgctatactcatagaatgagttaggaagaatgttttcatcttcaattttttgaaagagtttggcaagaataccactagtaaaaaatgtttaacaatatttctgctacctagtgccagggtcttttgattccttacgttccatctgggatgaggttcttcctcattgtaagtcctgcagtgagcaatccattccccaaactctgaaaggttctgaaacagaatactgtattttttcacctgatgttaaaatcaaggggtccaatcatttgcagcagattttattttcaaacaggttttttaatgaataaaatggagaaacaatgagattaattttatgtaaaacaatctgaaatttaaaatctgctcgtccctcatacgtaaatttacaaaccaccaaaacaaccaaacaaccaacaaaccaacaacaaaacagtgtctattaagaaaaaaaaaaaaaaggaaagaaatgggaaagaaaagagagaagaaatactaaagccggaatttgaaaaaacaaaaaagtaaaatatatagctacttgtaaagataaaagatgaaaatttctgtcttttaataaaggcatacctcagagttatagagaaatcggtttcagactattgaaataaagcaaatacaataaagcaagttatgctaatattttggtttccgaaggcatataaaagttattgttaaactatactatagtctattcagtatgcaatagcattatgtctaaaaatgtacataattttaaaatactttattgctaaaaaatgcctatgatcatctgagccttcagcaaattgtagtcttcttgctggtagcaggtgttgccttgatgtcaatggctgctaactaatcagggtggtagttgctgaaggttaaggtggttatggcaatttcttaaataagacagcaatgaagtttgctgcattgatggtctcttcctttcatgaaagctttctgtgtaatatgtgatgctgtttgatagcattttaaccacagtagaactgctttcaaaattggagtcaatcatctcaaatcctgccattgctttattaactaaatttatgtaacattctaaatcctttgttgtcatttcaacgctcttcatagtatcttcacctgaagtaaattccatttcaagaaactactttatttgctcattcctaagaagcaactcctcatgtgttcatattttatcgggagactgaaacaattgaatcacatctttagactccactttcaattctagtgttcttgcttttttaactgcatctgtattgacttcctccagagaagtcttgaacccctagaagtcattcatgagggttgaaatcaacttctttcaaacctgttaatatttgtattttgacttcttcccataaaacatcaatgctcttaaaggtatctagaatggtgaaccctttctagaaagttttcaagtgagtttgcccagatccattagacgaattataatgtaaggaagcttaaaccttacaaaatatattccttaaataatgacttgaaagtcaaaattactccttgaaccacgggctgcagagttgatgttgtattatcaggtatgaaaatattaatatcctgtatatctccattagagatcttattttctgatcagtagatctcaacaatgggcttaaaatattcagtaaaccatgctctaaagagatgggcagttattcacctttattgttacctttatagagcacaggcagagtagatttagtacattctggagggccctaggattttcagaatggtaagtaagcattggcttcaacttaaaatcaccagctgaattagaccctaacaagagagtcaacctgtcctttgaaattttaaagccaagcattgacttctcctctctagctattaaaattttagatggcatattcctctaatagaaggcttttttcatttatgttgaaaattgattgtttaatgtaggtactttcatctgtttatgttgaaaattgtttaatgtggctactttcatcagtgatcttagctacatcttctgagtagcttgctacagctgcttcaccttgcaattttgttgtgaacatggcttctttccttaaaccttatgaaacagtctctgccagcttcacacttttctgcagcttcctcatgtcatttggtctttacaggtttaaatagaattggggcctttctctggattaggctttggtttaaaggaatgttgtggctgatttgatcttctatctagatcactaaagctttctccatatcagcaataaggctgttttgcttcctttcatatgtgtatttgctaaagtagtacttttaattttcttcaagaactttcctttgcattcacaacttggctaactggtgcaagaggcctagcttttggcctatcttggcttttgatatgccttccctaataagcttaataattttaggcttttgattgaaaatgagagacttgtaattcttcttttcacttgaacgcttaaaagccattgtagggttattaattagcctaatttcaatattcatatgtctcagggaaaagggaggcccaacgagagagagatagggaaacagcctgttggtggagaagtcagaatacacaacaacattcattaatttagtttgctattttatatgggcacagtatgtggtgccccaaaataattacaacagtaacatcaaagatcacagatcacagatcaccataacagatagaataatagtgacaacatttgaaaaattatgaaaattaccaaaatgtgatagagacatgaagtgagcacttcatgtgggaaaaattatgttgatagacttgctcaatgccaagttgtcacaagccttaaatttgttaaacaaacaaacaaacaaaaatatgtgtaaagcacagtaaaatgaggtgtacctataaacttggtgggtgggtgtcaagggaaggggaggatagaaagaagcccaaaataaattttgtctcatccaaatcttggtcaagtgtgacacctagaggttgcacaaatagaattcctttgggtattttttattttttaggatgcaaaatgcatttatgtggagaattatttttaagtttttatttcaaaatggacatctttagatatttccatatgtaatactatcaataaataactatatttcttcacttttttataattataaaactgttgatgttaaaagttgtttccctttccatcaaggaactgaatatttcataattgttttaaaatattgatactaatgactaaaagtcattgtcatgagtctcatgagttgtaatatatatttatatgtttatgttctaataaaagagaaaacagatgtgtataggtatgttcacatccttacctctggagtttagaaatgatagcaaaattaatagaggcagaataaagacacctatcacatgagaggtgataagtttagaattttttcatttctaaatattaaaaaaatatgctttgcatttgtcattcattggtttggagaacttttatcgcactggctcattaatatttgaacagttctccatgaaaaatgacgaacgatttacttcatggcaggctgtacagatggtcaatttaatctgcatccttgagacttctcatgactaaattttgacatcatgtcattaaacatttgtgtattattatttatgtcatattctaggaaacaaatattgctatgtcttgctatctcttgccatctatcagttttattgataggatttatctacctagacactatacctttcacaaaggaacacatatcaggatatatacatcacttttgtctcctcagagacccatacatttttgtcctcaagtgcaataatgacattgttatgaacaaatgtgtggcaggtgtggagacaaatgtttatatgacttggattctctaaccttgttcagagatatctttgctgatgattgtgtgtgtttgtgtatgtgcatgtgtgtgtgtgactcctaggccttgtgtacgttgaaattgaaagaaggaaaccaaatgttggctattttgaaacagtactgcagaacatatcaccataattgtgtattgtaaatggcagcaaattggaacctagaaattgaccccgtataatgcttgaatttgtagctatgatgtttacactcttgacaagttgagttattattataccaccatgggtaaatataaaggtcagaatcttaaaatttcttttgacaataagctattaagtatagtgtcggatggctttttgaagggctaggtaaatgaccttgcacattaacttaattcctcagactctctgtcctctgttatataatgaattcccacttggtgaattgattggcgcttcccacgaatgcgtagaatggctgctgttagcagagtatgtccagtttgaaatacttcctgtgccagagttagaggatttcaaggtttagggcactaacagtagctgagaaatacaagcagaaaggatgggaaaatgattccttgtggagtggacatggaaattttcctgaaacgacagaacccaggaagcaatagcaggtcccatttccttctgtggtgtaactgtcaaaagaagtgatccttcagggaaccatacattagttaagatcaggcttcctttttattccttatcaacctataatcttttgattgttgcctgtttttcacgagtgaagaaatagtaagccacactagcttatctctcctaatcacagactcacagcgctcgggctctctgagcttttaattccttcttagaggcctaacagagcggaaagtaaacaaagaccaaatttgcaaccttcaacgtagctaatttcctctgatgtcagaatacttaaacaggcaggacctgggaattatttgatcaaacccgcttttaatctaatgcatgcagaggggctgtgtctggaaggctttgcaaaatgacaagggtcccaagggagccttatggaaggtttcctctttcagaaagagtagcttcctcatcttaaactctagggtagctatgttggagtaaattcataaaaagtagttttcctgcttttaaaattttattttatttggctgaaaattgctgatgggatagtagttttctttggctttccgtttgctgaatttttaatggttaaatgcctactattttagctttactgtgaaatgaattaataataaaatatattattattagctaaagggagaaggagaaaggggaaagcattatccgacttcacacacattcttctattactactggtagaagaaagtgaaaacacaaaggacaaaagatgcaaacacatgtggttccttatttagattgcgacaggcattttgctacagtaagagttaagaaaaatcggtgtcagggaaattttaaatgaagaatttactaattccaagatatccagacagcattactgactcagtttgactcacaactatctgaatacttagaagtagcatatttttgagggaaagaagtagatgaagggacagaactctatacctgaaatataattttaattttaagggttttttttttgtacaattgtatttatgtaattaggtagcattgcaaatactcattaacactaattcagttttaaaggctattaaaagacaatttaatttgtcacagagcatcaatattgctcatatttttattgataatagattaagttaaaaacaacatttaaagaagggtttaagtgcattttgacaagtcaacatttctgctctcgtgttttcacacctgatctcaaatactgctccccacacaaagtaattcagaagccatggcttaaaaatagataataaacactgatgctttgtgtaaatacgtactaagaatagcatgccactagatctagcatttgactccttggatgacagtgaatatcaatgcctgttatttgtcattctgaaatctgccgggtgatgattctttttattggtgcatccttccaaacatatttcatcgcaccatgtgcaccggagttctttaggcgggtatgtcggaggtgggtgtcgcctggctggcccctctcccctttgctcgccccctttctcgccctcgcgctctcgcctccctctgcctccagccccctctgctcctttgggctcacgcccccctcctccccctccagctggcgggggctgcgctgcctcccagacctagcagacctgctcagtcagctggggccccctgaggacagttgcctccggagccgccgggacctgccattctgcgaggaatggcagcggcagcagcatccccgccagaggcggcggcggcggcggcagcggccacggccaccaccgcggacgctattgttccctggtgttagacgcgctctccctccttctcatctgaagcgaacaatagcaggaaagagctttgctttctgtactctttgaaaagacgttccaagagcggagaaaaattccctgccgagcgtgctacggctctggaccctggagtggctgcaggcggcatggggctgcaagccaggcgctgggcgtccgggagccggggcgctgcggggccgcgccggggcgtcctgcagctgctgccgctgccgctgccgctgccgctgctcctgctgctgctgctacgcccgggcgccggcagggctgcggcgcagggcgaggcggaggcgcccaccctctatctgtggaagactggtaagtgggacggagttaccctttccccatcttcacatctggggccacattaaggagctggtgggcttctgtagggaccccggtgcttttggatggcttggttatgctggtatcctaaggtaaaaagtatgatttcttaggaagcaaataggtcatgtccgatgcaattaggaaagaaaagcataacaactaagaggcaacagtgagtagctggaatatttctctcgcagctctgtaatgagggcaacgcgcacttccatgatgaagtgcattatttttaacccctggattttcattctactaggagtttctcaaacagatttctagcaaagaacaagcaaagagtttagtctcagtctttattctttaggcaaagcaatatgctcactgtcatgacatttgtggatatagagttgaatttgttaactttagctttgtgatatgtgggacacctcagaaacaagccaagtgagggcggttccaacaattaaaggcaaatggggctccagtgagccttcagggaaagactgaaaactcaattattaactagcgagtcggaggatttttaaagtgtacaacttttaggatgtctgggttcaaactttctcttccttccttgagaattgttttgctttgtttttcaaccacccaacaaaagcagctactaactgcccatcattacccattggcaaaatgcttggagtttctggcgggggccgtgacaggcaggaaaacaatacggagtgaggaattaccaaccccttttctgcgggttcgctttctctctgcattaaaaaaacattgagaattccttaggggacctgaaacttcacatgttcataggaataaaatgggaaaagattattcctgttgcttagagctagggggtaatttaagaataacttggtcatgccaaacattaagagaatgttgtagttgaaagggaaagtatgtattcgtcatggggttgcaaacaggtttcagggagtgagtgtcttttcctgcttcagcccatctctgcaccactactgaagagacagctcagtctactctacaattgcatcactatcgatatctggaatttttaaagaagttgcagctatccagaaatttagtgaggagattaaacagaaatttatttaaagtcaaagtacacaatttgtcttagaagattacatgaaacatatacacattttaaaaagcaagattattcttgctaacaccttaagtttgaagatcagttgagtaatgaattcaaatgaaataaaattaatttacttcaatttgaaacgaagatttgaagatctctaatttagcgtaagctagggttttacttgttaaaagcacattcataatgacaaacattaatcaaattataatttaccattaaatggtatcatatggatgcttggggagagcttcttaggtaagtcagtgtaggatgaaatagtagttgcctagttgaaatttatactagcaaagtaacaagagccaagcaataattcagatggaaaagagcccagccaacattcactgtacagcatctgaggtgtcaatatatgtcatcataaatgtcatggtaggaacacaagccaataaacagtttaaaatagtgggaagctctcagaaacaatgatatggagaccttgattccagtgccagtcctagctcttgctagctgtaggaattttggcagttcacttaaattttgacccttagttttctcaactgcatgtaaatgtgatgacaccttcttctgcctatctgcagtgtgtgaaaatcacatgagttatgagaaagtgattggtaaacttcaaagctgtatgcaaatgtaagctagtgtgatgaggatgttaaagatatttcttgactggtgatccttggtttggtaaaaaaaaaaaatagttcattcaattggaaagcaaaataatgacttctttatttttttttttttaccaaagggaaaggagactttaatatatctgtaaaggagttgaacgtagttctcaaaagaactagagaatatttaaagaaaaaagatataccataaatgaaaatttagaagttacagaatcactatgtgtgtatcacttgatgaaaataaagaggcaagaagggaattggaagagaaaagaggtgacatactccaaaatatctgttccaatggggtaagcttggtcttggtacagaggattatagagaatcatattaatggtgagattattgaattaaaatgatgtagtgaaagttgttacactggatgaagatctgggacaggaactcaaactgtgtatgttactaacatgctgtagaactttggtaaagtcattaatgactttggttcttggcttcctattttgtaatactcattaaatagataaaatgatatctaagggcctttttaacccctaaagggcttcatatatatgaatgcatatgtcagatacatatattataaatacacacataaatacatatatacaacaaataagggtatataaagttgacccttgaacaatgcacagattaggggtcctgacctacatgcacagtggaaaatttatgtataacttttgacttccccaaaacttaactactaatagccaactattgatcagaagccttacagataacatgaacagtcaattaatacatattttatatatgtattatatactatattgttacaataaagtaagctagagacaaggaaatgacatttggaaaatcacgaggaagagacaatatatttactattcattaaatggaactggatcatcataaaggtctttatcttcatcgtcttcacattgaataggctgaggaggaagaggaagatagataaggggttggttttgttgtttgagcagtggcagaggtggaagaaaatgcatgtaagttgaactgcccaaatcaaatcatgttgttcaagagccaactgtacacatgtgtgtatacatataatatatacatgaataatacttattacttatacattatatgtaatgttaaatatctatctatctatctatctatgtgctttattaagtcaactcacaacaaagagtttttgaggagctaaaatatgtaaccactgtggtaaaagctgaatgggatactgccatccctgccattgagaagctcacaattaacttttttaaaaaaattcttattcaactgattacaggctttaggagatactcacaattaaacaacactataagtacacaattacaacatggcataccatacacatgaacagaacattataagaacaaagaagttatttggctgataaaggaggtgtgaagggtcgcaaagataatttaatatatgatctgggtcttgaaggatgaggtggattttgactgaggaaggagtagaaggccattctaagcagagagaaggaaaaaaataaaagtgaaaaggcacagcagctttcctagatcttgaaagtcccagtagtacacagcacctcaagcccaggatgtgggatagcaatgaaaagatttcatgccaatccagtgagttaggaccagattatcaataaactttcaaacaatggtaagatattggactttaacttataagtaggtggtagccactgtaaactttgagcagaagagtgatattttgtttgtctagaatgaagagagatgagtttagaagctggaaggccagtgacgtgagtcgttgactgagaggcaaagggaaacagaactccgacaatagaagttatagtgaagagtgagtagaagagggcttgaggtcacactgaagcaatgttagcttagatttagggtgcagaagacacagtgccttccagggaaagtaggaaaatgccatcaaggttttcatcatgcctgtagtcagtaaaggaggtacagggtatgaaaaaaggaagaacagattgcttagtgttgtgaagaagaatatcaatttaattcagatatactgagcttgaggtagcaatgacatatttagaccaatatatctcatgggaaaattagtgaatgggtgactcagtttaggagaaggagttaggctgaagatgtaagcatggaactcaataaatgtatatttcaagccatgggagtgggagggatcattaaagcaaagaaaatattgaaaagaagagccaggatatttcacagagaatattgggatataaagggccacagtgggagaagacctagagaaacagtctaagaaagtatggccagaaaaggtacaaggcaaatgacaagatacactagatgaagacggtattttataaaggagattgtggcaaaaagtattttaaaagtttagaaaggctaggaaaggaattctaaaatattttagaaaatatcaagtatgaggacttggtaagataattcacagtgttttgggaaacgacattttaggtatagaggtagagatataaacttgattgaataaaaaacaacatggtagaaaagatacagtatcaataaagttgaataactaagtggtatgtaagtctctctactacaatgttgttgttttatgaggaggaaaagcccagaatttcagatattaaaaattatttattaaaatataaaagtctgttgggcatggtggctcatacctgtaatcccacagctttttagaggtcaaggtggaaggattgcttgaacctaggagttcaagtttacagtcaaccatgactacaccattgtactccagcctgggcgacagagcaagatcctgtctctaaaaattaattaaataaataaaatataaaagttaaaattttcagcacttttgtatcacagtcatttcaaagttaacttatctttgtgtgaataattgggaagcatttcatacacacaagaggcatagcatttatattactgaaagatgaataactaatgttactaataagtgttaatggcatttgcatttttttttttttttttttttgagacagaggctcactctttttgcccaggctggagtacagtggcatgatcttggctcactgcaatcattgcctcctggattcaagcgattctcctgcatcagcctcctgagtagctagggttacaggtgcccgccaccatacccggctaatttttgtattttaagcacagactgggtttcaccatgttgggcaggctggtctcaaactcctgacctcaggtgatccacccaccttggcctcccaaagttctgggattacagggacatttgcactttttattattctagcatatgagattgtttctataataattattgttagttatattcacttggcaattccaaattaagagtgtcaatgaattgagcaaaacgcgactgacttagcattaatcagacaaaaaatgttgaatacataaacttttatcaacttctgtcatagatatattttcaaaaatatcttaatgaagtaattgaatttatttttataatgatgaaattacactgaatccaagaaacatgtacataatagccattatttagaattgaggtgatagagtatttacaggtatgcattttctctcaaggagaatactcacattaaacacttttgaactggattcatctaatgcaggacattactattactgacagtcagtgtgtcctttacatagtaattgcattaaaattatgcctttgttcttcaactttaataaaaacaatgttatctttttttacttttgtgtacttatgctaatagtacttattactctgcatataaaatattctccaatgtatatgcaaatatatctattttaattctaccaatctttaagtaacaaaggagagagggatatcattccaggtagtcataaaatgaggtggcattatcccaatacaagtgttttaaacttcaattgttcttacaatttacttttattcagaatgtcacactgttttctcacttcaagaatgagaaggatggaatagggtagacagagcatgagcgtcagcgttaatcaatctggggcatcatggatggaaaatactctattcatgtttcctaaaaagttattttatctccctgaatctttttctttcatctccaatatggattaatgggatgcattctataggggttttctgaggtttaaatgtggtaatgcatgtaacgtactaggagagtgcctgacacatattaaaagttcagtaaatgatagtttttattattgctattgttctgtcagatggtacaaaaactatttaagtttatgacctggagcaagcccaataatgtgcattagccttctcttaagcatcttttcttttccagtaaatgcactagaaaatacgaattgatacagttaaccagactagtagatactccaagttataagggagacaccattatagaatggaaagaacacggactttgagatcagacaaaccactgtttacatcttacctctacctgactggctaagttagatcaattctctggctctgtttttcaccttagaacaatgacagaagttctgatgtaagaaggcatttatgaagtttttcaacaggtaataaatagaaagtacgtactaccgtgacctaaatgctgcagacattcaaaaactgttagttctcttaccattctttaccagttattcccctaaaaatgacataagttgcagaaattttactggtctaacatacttatttgttttctccaactaaaggacagcatgaaagacaaaaaaaaatatatagaaaaattattgtattatagacatattttttattagtttggcacttatgtgtagacagcacttaccaaagactataaaaatgttttgagcaccaaatttagggttaattatgtaaatagaactttttatacttcattttattattgtatctcagggtatttctcaaaaatttgatattttacattcttgaaattaacattgtcacctatcaattctcaattaaatgctgtcactggatagttgcttgtattttatacattgctttgtttttacttggtaagtgatcatttaaatacattttaaaaaccactgcagtttgtgtcttgtctttttttcttttgtaatttatatagcaccatcagtgctcagaattcattaaaactatattggttggttggatcaaaaagtcaaattctcagggaattgtatgaggctttaactgtttcagtgaaactggagtaacttaggtcactccttctgaaaattatacacaactatctggtttgtaaaatgatggcagccctcaatcatagctgagattaagagtacaataggatggcacgtaatctagattttcttctgcccattattactgtatagaggacaggcctgatggtgggaggaagagattctgagtaggttattggtgaagtgcgattgtagtttgggtccttttaggaggaatacaagtttcttgacctctgatatgagttagaatgagaatactggatagtggagtttctttgtgaagagagtattggaagtccctcagtgtagtgaatatataggacaggatcccttagaattaatgtaaaggcacattagactggcccttaatgaaggaggcactgagcatgtggcacttgagaaaatatatctttcctaatacaagagacagtgcagactgtgaagtagaggtgccagtgagtcataaggtagatatcttttctaatttttttcatcagaactttacactgatagtttaaaatgcattcaagtgatgacagcattaaatgttgtcacagtagaattgtttctgttttgtgcattgttccatttttacttcataggtgatcatttgaattatttttaaaaaacactactgtttatatcttgtctgtctttcttggtgtacgtcgcacagttagttctcagaattcatttgttacttagatcaaaaaatgaaatacccaggtggtttccatgcatgtagttcctatgtacccaaacagtaaaaaagcttatattaatgggaagtgataaaacaattaaaagcattcatatataccaataatgatctagctgagaaagaaatcaagaaaataatccaatttacaatagcggcaaaaataaaatacttataaatgaatttaactaaagacatgtataatctcttcaaggaaaactacaaaacactgatgaaagaaattgtcaatgacacaaacaaatggaaaaacatcccatgctcatgaatgagaagaattaatattgttacaatgaccgttctgcccaaagaaatctacagattcaatgcaatctctatcaaaataccaatgccatgtttcacagaattagaaaaaagaatcctaaaattcatatggagccataaaaaagaacccaaatagccagagcaatcctaagcaaaaagaacaaacctggagagatcacattacccaatttcaaattatattatgaggctatagtaaccaaaacagcatagtactagtataaaaatagatgcatagatcaatggaatagaatggattacccagaaataaggtcacatattttaaaccaactgatctttgacaaagccaacaagaacatatgttggagaaagaactctcctttcaataaatggtgctgggaaaattgaacttccatatgcagaagaatgaaactagacccctatctctcattacatacaaaaatctacccaagagggattaacatcttaagcataagacccctaactataagaatactagaagaaaacctatggaaaactcttctggacattggtctgagcaatcagtttatgactgagacctcaaagtcacaggtaacaaaaactaaagtagacaaatgaaacttgattaaactgaagaccttctgcacaccaaaagaaataatcaacagagtgaacagacaacctgcagaatgggagaaaatatttgctaactattcatccatcaggagactaatatctagagtatactagatattgtaatatactgtttatgagaatatattggaagaacttgaataactcagtttttaaaaatcccactaaaaagtgggcaatggacatgaatagacatttttaaaagaagacatagaaatgattaacaggtatatggaaaagtgctcaatatccactacatgattggtgggaatgtaaattattacaacctctatggaaaacactatggaaatttctcaaagagctaaaaatagaactgccattcaatccatcaatccaactgctgggtatctacccaaaggaaaaaaaagtcaatatatcaaaagacacctatactcatcttaatcatagtactattcacaatagcaaagatgtggaatcaacctaagtgtccatcaacagaagaatggacaatgaaaatgtgtggtgtatatgtatacaatataatactattcagccataaaaagaataaaattatgtgtttggcagcaatgtggatagaactagaggtctttaacttaagtgaaaccagctaggcacagaaagtcaaatatcacatattctgattcataagtggtggtaaaaaatttgtacacatagatgtagagaatggaatgatagacaaaggagatttgggaaggttaggaggggagaggaggatggatgatgagaaattacctaatgggtgcaatgtgcgttagttggattttggatatcctagaagtcctaacttgatcactatgcaacctatgcatgtaacaaaattgcgcatgtaccctataaatttgtacaaataatagcatattgggaaagggtgagggaaactaggtaatacttggagcaatgataccaaaaagtaacctatctattgtttctgatgcataattggacctagccaaaaagatgccattgcatcctccagaaaagctgttgagctagttgttattttacagtttagtatgtgaaatcataacctttggggtattgttttctattatgcccatattattatatcaaagttatgctatgggaaaagaaatgaaataagggcagatggagaaaaagcacaaatgtgttcccttatatgaacaataattttcaaatgtcacatgcagtagggtaattttgtaggaggttccaagtcacaggggacgtcagagagagatggtccacatagaaggagtcacattagtagattcaggaaaagctatgcaagactgataaaacttggggaaaaagtgagatattttaagagagaaaaacagcacagagaaaacagaaatcaagcaaattatctgcattcttttaaaattattattttttttcttttgaggtgaacacttcaaagtttatttacatgttctgttttctcttttaagaatccaagtttcccaaattaaatgtttctaatattactatatatgcctaaaaaaataaaagaaaaaaaaagggcttttaaaatcagggcaagggagaagagataaaaagtcatcaaattagtcctcttagctccaaatgaaatgaaattaagaacaaaactgttggtttccaataggagtttcgttccattttccagcacatacagtcagctcagtctcagcgtagaccctcagaactgttagcccaacatatagtgaccattgttcaccatgttaaagagcatcactttgggtcctcaggaatgacattacataaacactttactaaatacctaaatagaggaactgagcaagaggcagccaaaaacaagttacaggacaatagacatttcccgcagtactttcataaaacatggtttggctcgtgatgaaatgaaaagtcccagaaaacctggctacaaggctgagggaaaatacagagatgatcctgttgatctccgccttgatattgaacgtcataaaaaacataaggagagagatcttcagcgaggtaaatctagagaatcagtgaattcccgagactccagccactcgagggaaaggtcagctgagaaaacagaaaacttataaaggatcaaagaagcagaagaagcaccggagagcgagaggcacgtccagatcctcctcctcttcctcccggtcatctcactcctacaaagcagaagagtacactgaagagacagagaaaagagaggagagctccacgggctttgagacatcgagactggggactaaagtctttgtgggtccaagtgaaagaggaggtggcagagcgctcgaggaaactttcaatttcaagccagaggaagaggccaggacagaggcaactactctgggaacaataacaagagtaacaatgattttcaaaaaagaaaccggtaagaggagtgggacctagattacacacccaaaagcaagaagtattacttgcatgatgacctccgggtcagggccggttcatgttctggaaatcaagcaccagccccaagtgggcccatgacaagttcagtggggaggaatgggagattgaagacgacaagagtgggacagagaacagagaagagaaggacaatttacagcccacaaccgagtagggtccactctttacggaattccttgcccaggggagagaggtgctggaaagatggctggcgaggagctaaacagaggaacctcaagaagattctgaaaaatcctacccccacccctcaccagccatgcagattgtactaccgcgggaggcatccctggcgctgccttccactggacagaggaggctggcggtggagcccgggggtcaggcccagctcttgagcggaacacaacgcattgggctttagctgtttttctcatctgttactggtgtgtggggtgggggcaggggtagggtgggagagcgatgcttggattaaaatgattttatttttaatagactttttggtgcagtgttagacttacagaaagttaagcagaaagtacagagttgccttatgttcccattctcccactattttcttctactatcagaatcttgcgctagtgtggtacatttgttacgattgatgaaccaatattactacattattattaaccaacgtccatggtttacattaggattcactctttggattgcacattctaaggatttttaacagatatgtagagatatttatccaccattaccatattatatagaataggtttactacccggaaaattccctgtgctccttctatttctcccttcctcctcccaaatccctagcaaagacatatctttttactgtctccatatttgtgctttttggagaacgttatatagttggaatcataccgtatgtagccttttcagttgggcatctttcactagcagtaagtgtttaagttttctacatgccttttcgtggcttgacagctcatttcttttgagcgctgaacaatattccatcctttggctatactacagtttgtttattcacttacctatttaaaggcatcttggttgcttccaagtttgggcagttatgaatattcatgtgcatatttttgtgtggatgtaagtttttagttcatttgcgtaaataccaaggagcatgctgctggatcatatggcaagaatatatttagctttataagaaactgccaaactgccttccaaagtggctgttccattttgcatttccaccagcagtgaatgagagttcctatttctccactcctcaccaacttttggtgcttttagtattttttattttagccattctaatggatgcatatcttgtttcaatttgcagttccctactaacatgatgtttcatctgcttgtcatcttttcatttgcttgtcatctgcagatattctttggtgatagatctgcattcttttaattgtaggagtaatagtagcaagagtaggtagccaactcttagctggcggagttcaaagtctcagtccagagtgtgctgcacatattccactttttattgttctggtagaatgacacatactgaagataattgttcaataatgaaaaaaaaccacatgggaattaagtaaggaataaatgtagatggtcctacactttgttccctcttgagaggagtatcctgggcgtgatgaatgatatcccaaagtagaaggaaataggcaaatataataaagattaagttaagcctgcaagctggtgagattttcaagtgtaatacatacctcctgtatccctagcggactctggtatggttaataaatcatgtagctgcatatctacttttccttgctttgcactgaggaagccattgtctgggaaaaagtgggagatgcaacatttttctgaacttctgggaaacagtgaaggtccactgtgctgaagccctagtaagttgacctggaaaccaagctgttaagtcagcctgctacttaggttgctcccatgaccttcccgttgacacacattgttgagcgccctcaggaaggagacaggtaaacaatgacccagaagtggatagttggtgtgcgtaagaatagaaatatagtacactattaacagcctaacgtagaacaatactgcttgatggaaaattaaatttcccaagcaaatgtattggacacagacattgattatgtagctaaaatagtttaacttatggtatgtggccaatacagggctttctaattgttctgtgtagtctgtagaaaatgttttcccttgggctattatagcgctagcaaataacaggacattctgagtattgtagatggatgtgtttgtaggtatgttctctattgcaccagagaagaagtggtatcagaacacaaatggtgactatttgatttgcactatttaaaagtcatttttattttctctacaaaaatcagagtgtgactataaacgttacagaggtccactgtattcagggatttccagattagttgcaaagaattgaatgcatagcttggaatgaaagaagcacctaatcaataactagttaaataaatatatgtttgtgtgcatttgcctgtgtgtgtgtgtagtcagtaaaaagatgtttaagaacagacttctgagccagaagtgcatgaattttgacctaattttgttatttattaggaatatgatttctaatctctgtcttttattttgtagctataccatgtgatatgatattagtaactacctctacagattatttaaagatagcttgagataaatctacagtgtacttagatggtgcctggcacaagtaactgctcagtaaatgttatcccttacttggctataatcctagtgtgaactgctcactggtacagaatttgtctcctgaatctatctgtgtcctttccttttttactttgattcctcttcctccttggatctgcatatgaatgtcaagcttctctgcatctgacattgctctgttctctacctctggtcagagtcaacagtgtaattacaaagctcagccttactgtaaggttgttcaaagtatggtttttaaatgcagagacattctgccccagtgttttgtttttacttgtgattgtgcatatcttagccatgcaggcaatgctggaggttggagtctctaagtgggactgtgggttccaaagttcctttgcttgtaaaacccgagattattcttggcaagactttcctgctcggtgatgctgtgaatgaaaggatgttggaagtatacgatgagtgatcagacttcctttcttaaactcctctcctgaaatgcattatgtgtgtgtgtgtgatatatgaatatcctactttcacatgtcaatatacgtggttcaaaatcttctgaaggaaatgaaaatgttgtctaccagcttgaaagagagacagctattcaactatttcatgtccattacaacccatttatttgtacattctttaaaatttgtgtagcacttgtaaacttctgacagaatcacaataataatttgatgcaccattataagcataatcacacatgtatacatgtctgcatatctagatgcatgcatatatatacaggcacatgcaaataatgcaatcatatatggcttaattatcacacaggacttcataattttacctgatattaagaaaattatacctcctaaaatatggttttatgtggtatttatagtagtgacttttaaaaatgtgtgcaattatacacttttttcactaaaatattatacaaaatttatattaagattttattttacaaagttttgtgccaagcttatgttcctcaataacccactcataaaagctattataaaagtccttgcattactttccactaagttatcgctttttattttaagaccctttttatgtctaaccatcttcctgtgtttgccactctggtgcctgtacaatgttttcaaactgcaatgcttgcacaaatttccaagaagtacttttctagtagcatctacctgccagcatatccatgaacactatttctctaaaacattacttgtgaatagtttccattgattatgacatcattgaggcaggaatggtaacagacccagatggaataatgtggattacatgtatctgtataaaaacatacattgcattgcataacgattttaggggactccattcacagtctgaattaagtgaccttttattccccagtttgtgttaatcaaattcaactgaggaaaattggcaggcacttagtacctattttatggcaaggtctgtgtgtcaggtgcaggggaacaaacatgaatagcatggagttctctatcctgtgtaaataaactatttgaggctagtgaacttattacaaaaatagaaacatatatggatgtaaaatggaggagggagtaattctcttgcaaaatgagacagggaaggaaaactttcataagacacaagtttgaaagataagcagtttacacaatggagaaaggctatagagagacagaattccaggcagagaaggaacagttgtgaagaaattaaatggcatgtttccagggatagaaagaagtttggagtaacaaaaagtaggaaataatttggggtgggaagaagggtgggtatgagtttggagaagaagggaatggatggatgacacagtcttttcataataataagtttatttgctgttttctgattcatagaatctaggagatcaagtcatttgggtttataaaatattgccaggaatgaaagaatatatttgtaaatgttaagtcagatgtgaatatatgagttttatatgattgttcatctaaatgaactattataattctccttgcaaactttccaagagaaatgctatcttaggtagtgctaattaaatgcagtaacttcaatagcgtagcatcctttcaggtttattaataagaatgatgtaatattttattttttcctctgcagttttgactaaagtaatattaaaataagtaaagcttaaatatatgtacatatatttatatgtacaggtatagaactcatccctgatgagttccgtgaaagggaatacaaatgaggggagtagatgaggcatgatataaaggctggctatactgatctcttctctgctgtggactacctggttaagagaagtaataccactcccttaccctgctgcaggtccatcacttgcaatcagagacaaggttcaactaaaaacaaaaaaatctcataaaggacaataccgttggctgactgcaacatctagtgggccaaaattggactatggggcattgattgacaacctttgcctttgacaatcatatcaggtcttcaaaaatatgaagcttaaaaatggagggtagaaaagatttttaaaagattctttttttttttgagttttagggaatggctacatgaaagtatatgtaacaacaaattcaaattaaagtgtctgagcaaccatgtttccagccaacatcaacatttctctatgcactgtgcttcatttgttcccattagttcatgggccctgtggagagaggagtaatcaggattaaggcatctgctgctcatgagctggcacagataatcacagaaatgcagcaaagatcagaagatccaatcactcttatcaaacagcttcttttgagagtttgctgtggtgactacatacctctaatgggagagtcatcaaaatggatttggatttatgaaatcaaataattcataaggagagctttgactgctgctaagatacatttctctccctgtctcttactgcaatatttaatgtaatttctttagttctcttggctcattgtataagagaactggttttgaactgcttcagctgtgcaagttccacaagaagagaataaatactatgaagcagacaaggtggtccttcaaccttggttgatcaagcactgcagaatcatgaaagtcatgatttcccaaatcatgatgaaagttttcagagctttcaagatcattcttcttgaggtaattttctaccctgatagcatcgtctaaaagctaaattattttgagtattttatgaaaaatgtggaaattagagtgaaaattacttttgtgccatgttattataaatgagatgaatctcctttgtttgtcacgtgctgaatacttgggattgccatcacagagccattcttttaacagctttatttgatagaatgcacgtagcatgcaatcacccatttaaagcatacaattcaatggcttttagcatatccacagacttgtgcatccattaccacaatcaattcaagaacattttcattaccccaagaagaaatcctgcatccctgagccatcagcccaggtcccgggcaaataccaatctactttttctctattcgcctagtctggacctttcatatgaatggcatcataacttgcgtgatcttttgtgactagcaccttttatttcgcatcatgttttcaaagtccatccatgttttacatgtattagaattccactggataaatacactgcctttgtttattcctcagctgatagacatttgggttgttcctaccttttggctattatgaatcatgctactatgaacattgatgtacaagttttagtgtggatatgtattttcatttcttgaatatatacttaggagttacattgctggatcttatggtaactgtatttttaattgcttgagaaactgccaaactgagccttattattattattattattattattattattattattattattttgagatggagtcttgctctgtcgcccaggctagagtgcggtggtgctatctcggctcactgcaacctctgcctcctgggttcaagtgattcccctgcctcagcttcccaagtagctgggactacaggcgtgtgccaccatgcccagttaattttttgtaattttagtagagacagcgtttcaccatgttggccaggatggtctggatctcctgacctcgtgatccgcctgccttggcctcagaaagtgctgagattacaggtgtgagtcaccactcccagttgagccatgttttttaaacccagcacagcataatacatactatgttttttgtgaatttcggttatgatataattgtcatttaaaaacatgtaattagaagataagtaattaaaaatataggaaagtgttttaggggacctaattcataagaataaaagtgcatttaggaagaaaatctgctgaaataatcatgaacacacttagtaggatgccaacaagtttttaatctgatcgcatagtgaagtcttcaataaagaaaaaaataaagtagttgggatggcagagctctcatgacttatcacttgtattttaaagttgcagagaaatctaaattataccaataaaaactttcaatgctaacctgttttggaagttgcctacatcgttttcacagcttagtggatggaataacaatacttccttgtattcttatggtactctataattccccaagcactcatgcatacatgttcttttactaaattctcacgatttcttcattaataataaattctcctttcatgaaagaataaactcaggtacctgaagttaagtgatttaacccaaaccacactcttagtttaaaaccagcagccaggacatatatcgtggtgtctgttgatgttatgatatacctaaaaatgaaattttctataaagtcctttaaagtatgcttcaatattttgattgaagaagccaaggtcagggaaaatactctccagttatgtgaagaataagtctccaagacttaaattagcattatatggtataaataataggtgataactgaagtttgcatttaatattttcacacaagcacagggagatagagtaaatgattacagacgtgttttgaaaaatattttgtctatgtgatatgttgactgatcactttaccatgttcttgagattttaccattttctcttacagtttccttcacttttgtgacgtaaatgataacgtattttatctaaacaatccgttgccctataattaaatataagtatattcccatattgtttcatgatgcaatgtatcttatttaaaagcataaagtgctgcttcaagctataactaaatattcagtttcagtatatttacattttaaaattcattttgtaaagggttatatagatttttactgtgaattttcttgaaagtaaataacgcaggagtttaaattgaacaccacacaacaaaactttctaaatcttcttcatctgtgtgtctcccaaaaaacctgacaggggcactctctctccctctccccatatctctctctctgtctcccacacacacacacacacacacacacacacacacacaattttcttttcttctcctttatagtctcagatttctctcactgtctctacaaatgtctctcattatgctcagtggttcttttctctcccacctcccttgtctgaccacctgtgttgtgttttgatacaatattgcagtatacttttaatttcaggaaagctttttcaagtatataaactgatgtaatttcatgaataggcatattatcaacaatagaaaatgctgactttcactgtgtcctttaaagggagaattgcattccagctgtagttttccttttcttttcttcccagaaagaatccaagtgaaaacctgcaagcatcattatatttgtccacaggcagctaagctgatatatttagtgtgcactgctgtatgggatacagctgtgaaatgagctaaaatttattattgcaggtaaaagaactagtataaatatattcaaatgaaatcctttgcaagcattacagtaaataggctttggaaacgttctcattctgtctcgtgtactttaaaaatgacttttctgaagatactacatatcttagggcatatgatgaaggagatgaaaattaggactgtcagtattcagggatttatacagtaggtttcttttaccactagtgcaataggatttttaacttgaattcatatatatgtttggttcttcctaaatctcgggccaatgtaaaaaagtctcttgaggaggaagaaaactagctactcctaaatgcatcatgagcacgcaaagcattttactccttaagtataaaaatagcaattttaacccagaggaaaacttgaaatattctttctttgttgaaggtctttacataacttgtgtacagtgcatggcattgtttcgtgtgtgtgtgtgtgcttgataattctgtcggttaatgtgcataggaaatttgttttcttaatcaaagtctggttaatggacaaaagagacattacacacaaatcaccaagttttaaaatattgtaaactaataaaatatccttaacattaacatcatatgccacataatttaatctgcagcttattgtgttgcagaaatgtcttcagaagtttgaagttcagcatcttcattttgaataaaaatgtattgctgtaacagaacaatgaggaaattctgggaaaaaattttagttggcagaaggctgaattaaacctgatttgaggagtctttagtcttcctaatttaattgtgtgcttttaagggatatttaaatgtttcaaaatttttctgaatggttttctacatttgaaaatgtatggagactcttaccattctactcacatccacatttctgaaagttgaaattaaaccaccctagggctgagctaatatcatcaataattttgcctacatgtccatgtgtatggtgtttctcctattatttgttacatcatattaaggcatctggaatggaaagttaaatctgaggtgaagacaaagtgttggctatttcttctttctagcaaagttattctccccatttccacattttgatctattacaaatataacagtaacagcagcattggggtggtgccctctaagcccctttatttactgcacaaacattttactgaactttagctatggggaagtatagacatgtatgagctcataatctttcaaggagatgtagacatagcaattgtaatcagtgtaatcggggctatcagtgaaggggagtgaccagcttatctgagctggagatgggcaaggaagggccaagaaaagcctgatatttacatttgtactggcctccaaaggatgtgcaaaactctgagaggtgagagatgaagggacatcacatggcgaaggcacagagacagctatctgaaaggtttacactctgaatagctcgctctctacccatgaaaccgtaggacagctccctgctggtgctctcaacaacatcagggattcttatcagttttacctcttgttctttctaaatctgccagctgtatgctaagagctagtttctacctggtcttgatttccttgatcagtctcttataatgtctccataggattgtctgcttgagttccaaatgttgatttgttcctatcccatactttttcatgtccctcagtttcatgccatttgaccaaatggttagtttgtttaactttcttatacagcccattgttctagaaccactaccttcaacttgagccccaaaatatagaataaaatcaaatattagatacaattctcagctctatttatcttgagccacgtatgacaccatttatgctttggtacatataagactcaactgtgggccttagcaggaaaaccaatgaacatttgtatgtaagaaatatgttgttagtatatacgttaggcctagaaattaagcaagtaagctagttccaaaattacttaaaataattcctttgagtttagaaagtgctttagctctggcttgcctaagatacaataatgcttactgaaatatttaccatagttaattcttattgctcctcttcacaaaaaaaataaaatttcatacattccaaagcctgtgaccataaggctatgaaaatcttcctgcaataagtgaactatgcttttgtatacactcatgggaaaccacacaaaaaaagaaaggtccttgtgaggagtaaaatgtaatatcatctttgaagtgcctgatagataagcaacagacagccacaactataatagtagaagattacagaatccaaaaattactctcctgtcaagaatcagttcaaataccacttgctctatgaagctcttgtgatcctcctccctgacttatgtcagcactttaacaacaatactctattttcattttcacctgtgcattcagtgtgtgcctccaccaaattactggtaatgattttgggtactttattgtttaagtatctctcttacccttatcatttaaatgtggacttcttgaggcaaaagctgtcttagtcatctttgttaactcaacatgtattatatactaggtatcagtacatggttgatgaatgaataaattacttaaacttaatttagcttaaataattttatatcatgtttttcacttcataatactcatgatgattttcttattttacaaaatattcccagaaattttgatatattttaatggtatgtatttctactatatgtatggtttaagtatttaatattcatttaatactggctatttaggtcattaccttttttattatgaaattatactgtaaatgatattcttgtaggtatatattttttgcccatctctgagttattccttatggtgcattccttaaaattcagtcctttagttaaaaggatgaatgaatatttttaagattcttgatacagattgtcaaattattatagtttatacatgtactagtaaagaataaagaccctagtttacatgaccaaaccgggcataacagttttaaaacctttgctaacacaacaaatctcaagccatctatctcagtattattaatttttaaaaagtatcttttaaatatgatagaaaacctatattttttcattttggtatatagttgtgccttaattcattttgtgctgctataacagaatacccaatactgggtaatttataaagaacagacaatttatttctcacaattctggaggctgggaagtcaaagaccaaggtgttggcaggttcgtttgtctggtgagggctgcactctctgaaggtgagggatgctgtgtcctcacacggtggaaggtgaaaggacaagaaagagcagacctctctgtggacctcttttatgagggccttaatcccattcaccagggagaagtcctcatgagcctaatcacctcttaaaggccccacattttaatattgtcacattggcaacaacttaattttggaagggacacattcaaaccatagcagtgtgtgtgtgtgtgtgtggtctctttctaaactgccctgcagaagttggcaccctggcgtaatcagaacagcttaggatggaggagactttcacagagttgtgtatggaaaaatgtatagatgggtggtgcagtgagaggccctctggggtacttgggaccaggaaacaatggggagcatagaagacaggtacgggagtgagtttcagtattgctctgacagtgttttgtttgttgggtgtcatttattttggtattacttaatttagaattattggttcttactgaggtctgagaaaatagtcttagaaagttagcttttcaggagaccaacatttttggcaaaaacaagtgaatttaagctaatgtattttagttgtagcaaaatattattgatttaaaacttaggtcaggtgatcttttacagagtatatgaggctaagctttaggtgttataaatcttttcatgaaaaataaaaagtatactgcattaatttcagccattaattagtgctattaataattcaagtcacttctaaaatgatttattcaaaataagtttgggacttgggtagactaaaaattacattatttaatgttattctaatttggtttactgttatgtaaatcttcaaatgaaaaagttgataaaatcaataatttgttttataattttactttattttatatattctttccatatcatctgtaagaaagcagggttttacttgattaatactacaaaaataattatagtccctcttaataccccaaataagtagtatatttgggaatactttcctttctcaaacacttacttcagggtgttattgctaccagtagctaacagccagtttgaaatattgacgcaaataaatttccaccttgatcatttgcacacccagtccctcacaggttttagtactaggtttgtatcatgtgatccctatggcatctacccatatggctgcccccaattaccacgtgcagtggagaagggctaaggaatacacagattctacacaacttccttaggaaatgcactgtttgtttaaaacacttcagagtaaaaaagtacttagtagtgatcacttgggtccatgtcataatgtcaacaccaaatattaaataagacaagtgagagagaaagaagaagaaagagatatatatatatatatttagagagagagagattgatttcagtctacaaaagtaaaaatgctgccttcagtattttgtgcaaatgagaaattatacttgaggtctgaggttagcagtggagagaaagacctaaagatctaagatgaggaacttagaaggcctaaaaggcacactttagcagcagaggggaatgcttggggctagcacttgcttattcttaactgtgtactgggcacctttcctccagctttggctcactacccagtgtccatgaaccttttctacctgctttccctcaggttctgaacaatgctctgtttttctgaaattaccagtaacaagtggatcatctaagaactgctggacaaaacattgatctattttaataaaggatatttttcattcaagtttcatttagaaacatcccttagctcaggcagtgtaaatgtgtagatgtcacctgcagcattgcctgaaatactcctgcctttttatttatctaaaaatatatattgtatccccacaaccacttttaagctctgtagactaaagctgaagtccctgcttataacccttaatgtatttcctttttaccatctttttgggaagctgaactctatagtccaaggtctaaaagttctttattttgtacattgaaatcaatttagggagttatctttatttaaatatttttattcttcctgaaaataaagaaaatgtgtatgtggaatttaattgcataaattgaggtttgagcacaatgaaaaatcaatgttttaaaaacatggagtggagctgcagttcctgacctgcatggtgcttgttaaccctcagaggaagacttacgtgaattattcagctgatcatagggtgttaagtagattctaatttgtttacaaaaattaaatgtgctttagcaaccaaagagaaaacctgaaaagataagcattgtaggtcaaaaaactgtgacaattagaactacttttgttaatgaaggtcaaaataaaaataaagaatctgtcactgaatagttttcccttttgtacttgcaaacatctgagatcctttagtaaggcaagtataatttacaatatccttttctcaaaacaagttatccattagttacagtcaaaacacgtgaaatattgagacatatatatgtatataaaataactgagccatattttaaaaatattttggcattttaaatgttgaatgtaagtaactataaaaacacttctgaatagaaatgttgtggtttttgatgtttaaaaaatgtttaaaattgcatgtatttgtaaatttgtcttaaagttgaaatcacgtatttcttttacattaaaagatactagttgacattttaaaaccatataatgatatgtgaatgaataaaaattatcaataaatcccttcatctgtgcaatatataaggaaattatattcttttaagaagctttagagaagtgtgaaagaatgttacagaagaattattctctatttttctctgttattctttattttaaagagcaattagaatattattcataatatagagaccactaaaatctgtgtagatttttgtgtatatgagtttttgtctgagaacattacattaacaagatatagaattacagccacaactaaaatatcaagtagatatacttttattgggtaaacaataattaatgtataatgtttctattagtattttgacagccatgggattggtcagtaggatacagaaaagagatagtcccatttccttcaactctcctttggaatgagaagaagtataaatatattattgcagtgggaacatgaatgcttcaagaaggcttcagtagtaaacaagaggaggaagtttggatgtatggaccaaaagctgggtactcagggacacagtagaggctcaggcaggtggatatatggtgacaactctagacataatgactacaatatcggccctagattaattgtaagcttccatagggcaccaatgcaaggtttcagctctttaccaaattctcagaattggtagaaaatatgagggttcatgaatgatgaacgaggaaaaatatccattaccaggatgaatgctgatgctttatagagatcctctattacttttccaacataccagttaaatggtcttagaaccaagcggggctaggcctgcacatggggaccgagaggccgcagatgtgaggactgaacagtaccaagcaactcattaagcaaacaatggaagtgtttaaaattcagtcacaatatttaaagcattaaaggtggcataagcctggtttacatttcctttgaggaagagagaaatgtaatgccttaatcattagctaggaatagaaagtcacatgatttcataagaatatgatttatcagccataaacaggttggtcaatgtaacccatgcagattggaacactgtatatagcactttgtgtatcacttttaacaaatctccaaaaacatttcaagcaactgaaatttcagttatgttgaattgaaatttaggttattttttaacgtctatttgtatcaagaagtgtgttctttttgttgttgtttatagaaaactgataacttcgaaactcatcacaaatctagaaaatgcaaatcatgtgttttctggaaaataggaaataaattcactatctttctcttaatacttagcattacatattttaatcagagaactcacagtaagagaactctaattactaatgtaatgctatgtctaaagattttacttaaaaggaaggaatacataaacatttattttaaatcctcattttatcaattggaataaaaatgagtgataatgacaaaaaattctattaatgataggtagtctttaatggcaaggcaaaagatatgttgtaaaaatcactaaatctaaaattcatttagatttctgaaatataaaatataaaccaaaataattttaataacatccattacttctaattgcctcctggacaacataatttaattatcttatgataattcaaaatacaaatacatacaaaactgtatttgtcatctttcagtacataactagattaattaatctaatatattgtaatgtatactgtgtgatgtgtgatagagcactggtttttatccttggctacgcattagatttactgaggaagttctagaaagtactgatatccagaccccacctcacctagaacaattagattgtcttggaatggacctgacattgatatatttttctaaaagctcatcaggtgattctacaatatagcggcagttgagaaacaatacatagaattaaagattccgctgttaccatagtttatgttaacagggattcttatctagcatagccaagtaggaaataaggagcctcaatagcatctatttatccgtcaccataaatgagtatatctgtgcccaaagcaaaatgctgatatttaagcagacataatctagtatttctttctccttttctcctctctctcaatctcatagctcttactcttccttgatgtctaactctccttctactaattgtggagagtcttttagcttcatttctaccctaaaacccatttatgccaaaatggagaaaataagcataaattttgaagcagaacttatgggatttccacttttgggtctattacttgatacatcacatgtgactttgcttacattgttaatttttctaagcctcacttttctccactataaaatattgatcaaaagtcctaatgtaaaatatagagacaattaaagataaaatactcagcctgtctggtcacccaaacaaaacaggcatttatagtaaccccaaggcccatgaacatgctgctgcctgttgaaaaagtcccaccttcaccctcttaactcctcttcttcctttagatttctcaggaaaacatttactgtcctctccctaccaaattatcttattacatatgcccttggctccatccacctctccttttctagatttatcacagatgttatttaatatatgtatgatcacagatgttatttaatatatgtatggttatttgactagtatctatattctttccaagagtctaagatctctaaaggaagaaatgttatgtctagattttctcattattgttttttgataacatagcacggaacttcacacattttaggatgcagatactagttaaatctgcatggatggattgaaggatggaagactgaatatatattagtggaaatatttaacaaacatttagtaagtgttaatgttatacatcaaggaatttaaaacatatagacacagaattttataaattagttacttccatatcctcactttaatcataaaaatgttaactaacttgcttaaaaacacacagattagaaagagcagaaccagaatatataacttattttctggcccactcttaactcaacctctgtctctctatccttctctgttatttattctgattatttttaaatctaaatgagctgattccccaggatccagagacctttcttaccatgtccctccttggcttccctacagtttagtgatcacacattcaaaatctcaggtctgcagtctcaaggccttcaacacacagatgttgtttctcaaacttttgtctgcatcagaatcacatgagaaaataataaaaatgcatatctcctttccttacaccaaaagattttaattaaatagtatagtagggtgggccaggtatatgcatgtatatgaaattcacaatgataatgcaggggtcaaacctacatctatgctggaggaatttaaaccctaggaaccttgatttggaaaggagatggattttgaatgatttcctaagtatggagcaagggaataattaagttgaaaatttctcatactctaaaaccaggaaatttcagccttgagaaaattgtcagccttgtgacggaagttttgtggttagaaattgttacatcctacacaataggcagaaaagctgtcaatataaataacctttaacatcatattgaaatacttactctgaaatgaaatatattcacattgtaaaaaataatagtaaaataatttatgtcaactgatttaatgttattcctgataactatgcagtgtgagaatatgcctaaatgttcttaaatatgtgttactttaattttgtggtaagctttgcctgactggaacagtacatagagttttaaaatgtattactcttcaacaaattagaaaaacatgattacgacatacagattttttgtcattgtttttgttgttgtttggctttactttcaagctactcattttccacatctaaacaaaatgtattcttttttttccagttcttttggaaaaccttttataaatttgaagttatatgtgttaatattttatatgctaatttaaaattttaacttaataatatagactacagcactatagaatccacgatattttgaggggttctggaacttttgaactcatatgcaccagggttaaaattttgtttctggcactttctaacgttgttaccttggacaagtttcttaggccctctatgcttcaattcacttatccatacttcgcacatgctttgtcagcattagattaagtaatgtatgtaaaagacttactttggtccttagaaaagagtagttctcagttaacaaaaaaaggaagaaagacagagagagagaaagacaggaagaaaggaaggaaggaaggaaattatgaggcagtataaacacctagtattacatccagcaacataacttctttttattttttagctttattgtgttataactaatatgcaaatggcacacatttaatacatacatcttgttttcattaaaaaaaaattttttttgaaatggggtctccttgttgccgaggctggtcttgaattcctgggcccaagagatcctcccacctcagcctcccaaagtgctaggattacaggcgtgagccatcacatctggccaatacatatgtcttaatgagtttggacatatatgtttacccttgataccatcactttgaccaagatgcaaaatatattcagcacctccagaaatttctttgtgttctttgtgtgtgtgtgtatgtgtgtgttgtaagaacacttaacatgagatctatcctcttttattaacgtgcacaacactgcattgttaactataggtactatgttgtagagaagagctctaggacttactcatcttgcataatagaaactttatactcatcgaaaaacaattctccatttccctctcccctcagcccctggcaaccaaaattctattctctgcttctatgaatttgactactttagataccttgtataaatggaatcatacagtaaatgccctctgaggctggcttatttcacttagcataatgtccaatatgtacatccatgttattacaaatacgatattttttttcttttttgagatggggtttcgttcttgttgcccaggctagagtgcaacagcacaatcctggctggctgcaacctctgcctcccgagttcaaccgattctcctgcctcagcctcccgaatagctgggattacaggcgcccatcaccacacccggctaatttttgtatttttagtggagacagggtttcaccatgttggccagtctggtctcaaactcctgacctcaggcgatcttctcacctcggcctccaaaagtgctgggattacaggtgtgagccaccgcgcctggctcaaataggatgtttttaaagactgaatagtgtttcgttatgtttcacaacccaaatgtccatggacagcagcgtaactttttgaactgttgtaggacaaggggcttctctagactcctgcagtcttccctctaggctggtctcaagtgctcgactcctctcctcctggatttctgcaccttcttcctgtgatctcagtgcacatagtgaagccagcgccttacactctcctggttcagttaaccaccttttaagggttttcctatctcaaagaaagaacagaagagccttgttctatgttatttttaaatgtgtgcgctacagtagcaaaatctacaatttggttgctaattaatagtgtaatcttgagcttcaataatcaaaacaagtgaactggatttttctgtctaatcacatgcagacctaaactctctcattctgtaatgtcttctcatataacaaaattcttcctatattgtgccaatttgatctagctttgtgtagctttgtgtatgataatcattaagcaaaaaacaaattgtgtcaatatgcataggaactattagtatgagagaaaaaacccaaaatatgcttatttcttttgctgtcaataaacaatacagttgactgctttaggatgacactgaggaatgtgatctaaggaataagtgaatttataccataggcatatttatttaagaagattgatgaaaactctgagaataaaaaaattactttctaataagatacatttttattcttgttatacatgatttaataggtttattaaatgagcattaatattttactaatgtggttttgaagtaatatgatttagaatgtgatgtagtctaaaaatcattataaatcaaaatccttatgatttacatattaagtcattacaaataaaaagaacatcagtgctaaagaagtttctccactggaagataaagcacttatttgtgccaatccgtatgcttttactaagtattcttgcagctaaaacagtgattctttcttggtgattttaatcataaaagttggtaaggccgggcgcggtggctcatgcctctaatcccagcactttgagaggccaaggcgggtggatcatgaggtcaagagatcgagaccatcctggccaacatggtgaaaccccatctctaccaaaaatacaaaaattatctgggtgtggtggtgtgagcctgtagtcccagctaatcaggagtctgaagcgggagaatcacttgaacccgggaggcagaggttgtagtgagccaagattgggccactgaactccagcctggtgacagagtgagactctgtctcaaaaaaaaaaagagttgttcaactaaattctcaactttaaaccaaaatacatatactaaatagataaataggcaggaaaaaatgatttttaaattacttgctaaaatgtttagtagcccacctttatagagtactgttttctaaaaaatatgaatgtatctaatatatctgcatggtgtcatttttgatttgcaaaaataaataatttaaaaagatcatctgaatcatcagttagataccaactttaccaattaacagcataaaagtatgttcacatttttcagttctaatctcatgtgtgttaaaagtatttcattaaaaaatgacaatattgttcaaatcacctaaataatagtgacacaggtgtcctcaatttgtgagcattcttcagacacatgttttgtacaatttttatttgcatatttctttctctttttttttttgttttttctttttttgttttgttttttggagatagcgtctcactctgtcgcccaggctagagtgcgatgatgtaatctcagctcactgcaacctacgctccccatgttcaagcaattctcctgcctcagcctcccgagtatctaggattacagacatgtaccaccatgcctgggtatttttttgtatttttagtggagatggggtttcaccatgttggccaggctggtcttgaactcttgacctcaagtgatcctcccacctcggcctcccaaattgcgtatttatttctatcaaaagttaataagtaccagataaatgtatgatagtagtaagaagataaaattagtgctaataatcatgctgtcttctgtcttaatggaacaaagatggttaggtgaatcctatacaacttgcaatcctactgtgcattaattctgatcagtgcctttgccctgccttgactttctatcttcatgttgctcacaatgtctatatttcagattttttaaagtgaaattcgagatggctgagaaattttctctgacaagttatttaaaatattattaatctcttaagcgatatcctaaattaaatgcaactagatgactctgtattaattaagtcaaacattaaataagactaaaatagttattttccaaggccattaatgggagtgatgtctggctgagaatgatgtcagatttttatttagaaattaatttagcatgctaatgagtatgaaattccacaagcatctcttattagaaaatgaaaatcaagactgggcacagtggcacaagcctgtaatcccaatactttaggaggccgaggtgggaggattgcttaaggccagaagtttgagaccatcctggacaacatagtgaggttctgtctctacaagaatattaaaaaaattagtcagacatggtgatgtgcatctgtagtcccagttactcaggaggctgaggtgggaggattacttaaacctaggaggtcaaggctacagtgagccaagattgtgccactgcactccagcgtgggttacagaacacgaccctgtctgaaaaaaaaaaaaaaaaaaaaaagagagaggcagaaagaaagcaaagaaggcaggaaggaaagaaggaaagagggagggagggaaggaaagaaaattaaaattaagaaagcaaaatgagtaatgtggaaattagattgtcataaataacacatggcttaaatgtgttatccataattaacaacagcattatgaaatatgataccagataaatttgaaagcaaacttttgtatttctgttagaggacagaaggtaagaaaataaacataaaatacatatttgggggatatacacatatatatttcactagtcaatgaattgttttgattggcataaagtttcaaatatgagaattcccaggatgtctggggagtttaaccatagtgtttccccaaataatgttatctattagttgtctgcttttagggatttttcagacattcaagtcaaatcagaaatgaaaaaaaattacctgccacacattaaaattgttattcacatttaaatactttagcggaaattccacagtgctattttagtatacactttaaaccttattacagatataatgattgtacaagacctaacataggatagtaaatgactaacatagtatagaaaaatgactgtacaaaacctaacatagtataaaaaacattaacattaatgagaaagtttgataagtacctgggtgtaagataaatatacaaattaatagttgttattttgaagtaactgtgtaaacatagaaaagaaaaattacttttcccattatctataaaataacaatagtaataaacgtgaaatacttagagataatcttacaagagaaaaggaagacctaaatgaaaaaaaaacacacattttattgaaaacatcaaacaaagactgcataaagtaaatagcaaaatatgctgtattctggatggaaattttaatattagaaaaataaaaattcttttcaaattaatatgaaagtgtgatgaaattgcaattacaatagcaatggatttctgtcgagagctgtacaaaattattttgaagtttatgtgcggagtacatacaaaagaaatgccagtatcctttttttttcaaagtggatggacatttcttaccagatattaaaatttaatggatatgattttaggtaaaacagtaaattttgtcacaagaatagaaatatagaaatatatatcagtagaaagggtctagaattatatacaaatatatattaaagcaatatacacatgaaactcatatgattcaaagcctagaacacacgagacgatgaagattaatcaatgcttcctaagtgtctacatcgttacacttttgtagtatagatcattactgatccaaatatatatatatatatatatatatatatatatatatatatatatggctaatttaatttcaaagaagtaccaaaaatacatgttttagcacagttacaggaaacagcttaagcataattgggagcattacaatttataatgattaaaacttcattttaaaataattgatttgttgactttatatataatattgaagttgatgaatttttgcttagttgtttgctgactcctcgcttggatcttccttgatcccatatttttgctcctgtcttttcccaaatatcacatttcccagggcctcttcctccagcagctcattgaacactcacctcttattttcagtttttttgctttctatcattttcaggaagcagaagcgtaagggagcagagaaccctctgacatatgtatatttatttgtaaattttatatgcaagttattctgtaatagaatatatgtttgaattataagtaaatatctttatttcaatcatacattgtaaaacataaaactagggactaatacaacataatgaatgcgacctacaaattgtactagattttgaagtttgttttcgtcatgtcattcccgggaaagtgactaaaggccatctgttatttgtaaaacatcaatttaattgtgtgatttcctacaaataggataccatcatcttttgacactatcctatcataaatcataaatggcttgctgataccagtaggggtagagctcggggttataagaatattactgtaactctttatattttaatattattttttctctctaaaatgacaagaattatgtgcatgcttgtgtgtgtatgtgtgcacacatgtttgtatatgtgtacaaatgtatgtttttaattttgggatgctaatttcacttagaatgctgtaattttttgaaacagaaagatctctctcaaatcttttataaaactcggttaaagacaaacaaaaacccctgtgacgttctgttaaaatataatatatttaaaaaacaactcacctgtaagtcctctaacttttagatagaataccatgcagcctatgttatgcatacttcaaattgttctagaggacaaaaactccaaaagccaatgatagtatttataaagtatataatttatttcattgttctgcatacttagaaaaatgaaatcctgtttctattccatctgtgtgtttttgtccctaaatatagctcagttggaaaaaagtgaacttctcatgcacagtgctctgacataaagaatttgcttctatttcaaagaaggcaaacatggcacatatgcttttgtaggatagtagagtgggtgggagggctgctgaaaaatgcctcactggcaaaaagacttatttttcaagtgactttatgaagatgagcccctcattattgattcttaggtcttaggcgatgatattaaagcttactggaaaattaagcaagcttaaatactggtacagaccccttagcaataccgctttctgcttcacgctgtggattagtaagagattgacctgaattaaatccttatatcatgttgcctgatacaaaagaggcaggggggagagaaggaagtcgatgtgtagaaaagaagagatttttcatttgcctttacatctggtctgaaagacatcactaatgatcattaattcctgagcagaagttagatacggatataattctaggccaagaggatgctattcagttggactcaatatgaaattctcaattaaattatgcaaggaaacactgtcagagctttgaagtgctgactcaaatttttcaggttctgagtaaaattattttttatgcaactttgtagtatatcctttagtgttatattgaagacaaaaagagtggtaggaggtataacatgtattttcacctcacagacttctcttatctcctgccctgtatgtttacttattataatggaaattacatatgttagaatataattaagtaaaggaatatagaacttaagaaaatctttaatcatctgaaaattcctgtttcttccaattatctttcacttttcctcattatttcacattcgtttttgaaaatgggatctaaaattcattttttccctagtttccaaaactttagatcatttgacactcaattatttgattacccgattgaaaatacatatgtatattgttagttttgatttctgttttttacttgtgtttccttaaaaattcaaaaaaagaaagaaatcagaaataaaacacccacattggaagtccaaagcaacatgccaacattaagcataaatctttttgttctatttcgtttggtaaatttttaagtagttgaaatttaacatacaaaatttttatatttggggattcttaattgaaaaatatagtataccatttccacatgacttttaaaaagtatcttcttatttcatgactacataatattccctttataattattcttgtactttttgccatatgtttcttcatttttttcattttaaaacaatatatcttctttgacttttttcattttaacctattttctaagattgtatttctaaaactaaaaacattatagtgcattttcttcccatgattttcagattcttcagtttttgcttatttatttttaaggtctaaatgttatttctaagaaaattattctgatttctttctcagaggcagaaatgttttcaagttcactctctagttcctgtatgttgtagctttcctttatatttttctattacctactagaagaattatttgcagattttcttctgtggctgaagattcggccattgttatgttttgttgttttgtttaaaaagtagacaataagtctatcattaaaatttcggcatcttgaaatacttcttaccccatctttatttttttaccccttttaattgtcttttcatctcatttttttcagcttaatttctccttctagttgtccctttctgttcatagagaccatctaattcctatattcatttgaaagatatcaaacagttttatataactttttctgtttcccatcataacttattaaacatataacaatattttaatttatccacaggtataatgctttgaagtcataatgctatgggatattgcaagaattgtaaagctacaactcacagggcaaacctcacccatcacctgtttgtgcaaatgaaattttactgacacataacttcatccatttctttatgtattatgtatggctccttctgtgctgcaatggaaagttgaataactgaaacagagattgtatggatcaaaaagcctaaactatttacagaaaatatttaatggcctatggtatagtggacatatatatatatttaaatttttatttgtttcgtttgctttggattgcctatccattttttctctgtaagagcttccagtaccctttactggaattacatcttcatcatttgattcagttagaagacattacattcactctgcaggctgaacaaatgatcagagctaggctattcaaatgtgctcctggaatttgtatttgcgtagattgccctgtgtggtggagctgtgattagattgtccccactataaggcttggtgcaagatatattgggggaggaaagttggtaataaactcaggaagatagagcttggcgttaggagtcagatgattaaggactcatgtaccatgaaaagcagtttgcaacgggcagccatcaaggacttttcagcaggaaaatgacatttagatttatgctttaggcagacagatcactttgctgactgtgaaaaagctctttgtagaattgaaaagctcttctattaccagcagactgatcagttatgattcaaaatagtcaagccagaaagggcaagcgacctcagtaatgcaataatgatggagagatgaaagagtgatatttagagaataaatataatgacgagtaagaggagagcgtgaaatggagggagaggaagagacagttccaaggattctggtctggatgactgcattcatagtgggaaatatacagagaataactagtagaaaatcatagttcacagtttaggcatattgaattgaaagtgtctttagcgcttcttggtgaaattatggaatgaatagatcaccagaaagcaagaatcaaattagtaaaaaagcccctgtggatagcccccaaaaatttctaaagcaaatggtaggcaagaaagaggcggcagcaaaaaagaacaggatgatgaatccaaagaaaggaaatggagcaacgcaccgttactgtatacacactcatttcatgcagttcctctgtgactttagcaggtaggaaatattttttattttcttctatgaaagaagaaatggccgttgggaccaaaatttaacatttaaagaactacactagataggttatgctctcttttcgtctaaggaaattcttacaaggaagtccacagaaaataccaaggttgttataatttattaaggaatttcctctacaaaacttttcttcctatcagcaagataaggcctcaccatgtaatacactttacagaaaacttcaaatatgatgatcaactaaactttgggaaactacaactttccttcaaccctcaacaaaggataaatatatttgatcttactgcttatgctccagaaattttccagaaaaagaaggtaatggggtagggaggataacatttatcagtatgagaggaaagcagtccagtaaaatttccatacccataataggagatagcaaatgccaattgccaagtaaattggatgaagggcttttggtaataatcagagaactcactcagagcaagcagctgaaatgtgttgtcttcaggattttagactgtaatctcaaattacgtttatgtattgactatcctgtgtcctagcaggccaattaagtacatattattaaagttgtcaaatgtcttctccacagaaattgaagttttaaatgtagttttcctttatacttgctcttgttaagttacagtggataagaacattatacaaggcttgacttccaacctttctcactatgttttttattcttcacaataccatgaatatgattgcagattacagtagaatatagagggatctctataacggattttgttctttaaagaataatgaagggacttagagatgtaagtagtcaaccaagtgaaaaaatgtttattttaaattttattttttgtataaaaattagagaattaagaaaaataacctgttgcctcactatcttatcagaattgtctgccagtctttgtacatctttgatttttataaacttgtaattatatttatgtgtggcatttacatagatgtacctatatatggataactgagtctaaaaatttctcaaataaaatcatttcataaaaaacttttctagactgctaaacacatcatgtgtttaccaatattaggctgatgttcttcagcaaaaaatttaagaaacatttttaaatagaaaaacatctcatctttttaacgtagttttcaatttcttcatgcaaaaatgcacttttatctctcattaagaagatcttactttatagacatgaatccttcctgttgtgctaaaacatttaatgaaccaacatataaaaatttaaagagcttgcatatgaaaccattctattgtaaagtaaggaactggttgcttttttctgaagccacagcaaatctctctacaattgctcatattcattttgcacaaatgttgcaaaatagagtatattggtttacaactcactcttttaaatagagcatatatttattttattttctctaccttattggtagagaaatgtagaaagctaaatattctctaccttattttctgaacaatatagcattagctgagctacttaatttgattttcaacactttcagcttcaataatgtgtgcttttaactctgatttttgaaattaatacttaatttgttcttttttaacctcaaaaagtatgtctttttatctccacaacatttaattttcaaataaatattgaaataaatatatcaatgcagtgcaaatattttactgtgaatttttataactttttggtacctgattctaaacaagtacacaaaattactttctccagaagacagttagaacacaaaattggagacacggaagtccatatcatataaatcctgcctacaaggagcttacaggatacttaggaagaagtgcacccaaaggagttattatgcatccagtgccaaaaggaaagtacagatgcatgatgatttaaaggagcatcaagagagcctctaaaacaaaaaaggtatttttttgagttggtttgtaaaaggcaatgaagttgtccaatggatgtaaagtttcagttatgcaagatgagtaagttctatagatctgctatataacatgtctatagttaacaatatagtactgtgtacttaaaaatgtattaagacagtagatctcatgttgagtgttcttaccagaaaagaaaaaaaaaaagacaaataaatgggcaaaaacatattcaaccttattcataatcaaataagtgtacttctaaagtaaaaaagacatgttgccagcttataaaagaggacgagtgtcattttctctagcctggctgactgcagtgacctcctggctggttttccttcttccattcttgccctctgcacagcagtcagtatgatcatgccacgccctttcttaaaatattctgatggctttcatttctcctcagaataaaagcataataaaagcataacagttaccagcaacggcctacatgacaggttgattgcccatctttctgatctaatttcttgactctgttcccatttctcagcaaagttccaggcacactggccttcatgttgttcaatgacaccactttgcaattccttctgcttggaagaccatgactttggatctttgggggactgggtatatttggtaatttagcttagtgttccaatgttatctgttcagagatgtcttccctgaccatccaatctaattgccttcttatccagaattcctgtcaatcacttcacttggtttagtattccctcattacatttgttcctgtttgacacccacttgtttatgtaactgcttgtttcctgtctgatttccctcactagaatataataataataacagctacatttattgattacctattcctttctggtactgagtctgtacttagtgctgactatagccatgtattaattcatttaaacctcagaaaaacactgaatgtttgattatattattgtccccattttacagataataaaatcgagtcacagatttaaaaacccaagtgagtagtaaaaatgaaatttgaataaaagcagtctgatccagagcctgtgagtttatccacaactctatgctacactccgaagcgtctctacattgaatgactttgttgatgtatagaaaagggcatgtctcactgtctgcatttaaataactgtttaaaattttaaaagatactctcggtcctgaataacatatatgggcataagcagtttgtgtagcagctgaaaggaagacattttcaagatagtgaataataacaagaggctctcaggaaacaaaatgggcatgaggattggggggaaatgctcagagaatacctcagaaatataaacctgggaggatatatttgggcaagactatagaagaacatatacgagctaagattagacagtggcaaaacagtcaaagtattaatatttaagtgggagagtaactatcaaatttctactttaagaataatgtggcagaagcatcaagaaagaactgtggaaggaagatactaaaaatgactgcatcattactgctgtgatacaggcaagagatattaatgacacaaatatggtgggttcatagaaatggttgggaaggattagatgcaaaagatcagttacagggtgaatgggtacttgtaggatggtggtgtcattaagaggaagaaggaaaacacacaaaaaagaccaaccttgtagccaagatggtgagttgggttttggatatgtgaactttgcagactgtagaacattcagttggaattccagcaggcattggtaacatggaactaatgcctgagagtggtcaggtttggagaaattggtgagccatttctagggcagtgagaattggagttaagggtattaacttttagttaatttagttttgtaagaaagtgtccatctatcttccagagtgcctgtaccgtattgcattcccaccagcaaaggaaaattccccttgttttacgtccttaccagctttagatgttgtcatggttttgaattctagttattctaaacagtgtccagtggtatctcattgttctaatttgcagttccctagtgacataggatgtgaaacatctttcatatgcttatttgccatctgtatattttctttggtgtagcggctgtttaggtctttcgcctatttctaatattgttgtttgttttcttattgttgagctttaagagttctttgtatattttggataacagtcatttatcagttgtatcttttgaaaattttctcccaatgcgtggcttgtcttctcattcttttagcagtgtcttcccagagaataaattttaattttaatgaaatccagtttatcaattatttcttttttggattgtgcctttggtgttacatctaaaaaaaattctatatccaaagtcatttagattttctcccatgttattttctagagttttatagttttgcattttatgcttaggtcttgtggtccattttgagttaatttttgtgaagaatgtcagatctgtgtctagattatatatttttttgcggtgaaagtccagttgttccaacatgatttgttgaaattgccttttctctattatattgctcactttgatttcaaaaggatccattaaacaattcaatctgagtgttgctctcaggaagtataagtcagttcaatgttacctttttatttttttatgaaactagaaatccagaaagctaacattttcttaatgcttaaatgttggtaactaatttaaaatttatatgaactctttagagccaagcactcatgtcactaaaatgcctaagggccaccagtttgtgactactgctctgtgtgaatggttggtgaagaaatagagacagcaagcatgtataatttgtttgatgttttaatttttgtcagttcggtgtaggggaagagagagaccaaagaaaagactttactagcattacattggtttttctttttttttttttttttttttattattatactctaagttttagggtacatgtgcacacattggtttttcaagtaacaaaacccatactacagtagtttttgtttgctagttttcaaatggtttgtttttaaatggtggtttattattccgttaagaagttagagcgaggcatctaggaagttctgtggctaaaatatatatatcaaagtctcaagtgctttttctaatatcttttctgtatatcaaagtctctaatgctttcataccttttgtagcattacacctttctcttaaggtaacaacttactgttgcaagacagtgctgctccaccaggcttaaccacattccaggcagaaaatgtggaagtggtggagacaagttatttctcctggcaagctctcctgtttgtttaatgacagaatctctccgcaggggtttctagcaatgttacagtggtcacaaccatgtaggatggctatttctgactccaagggagaatgtacagttgagttattggcttgctagtctttattgtggaggaaggtaaggaagaaggggttagtgatggttttcgtatagtaggtccagtgtctgccacagtgctgggagagcagttactataaagaattaaccaaactattagagactgggatgaaggatctgttggagaaagagcaattgaagatttaaaataaaagggaatgattcataaaacaaattattattttataagagaagggaggaagaaatgggttaattatgcagagatattccataacggataaaccagtttaaagaaaatcatttcagattgaaataggaaatgagatctatagggggagcaaagaaatatcttaaaaatttagtgaaagatgaattaaagattacaaattaaccctaagagcacatttgatgttttaaagaattagcctattattttattctttaagtcttagcaaactgatagcaacagcatgtgaagctcgattgagggtaggatattttcaatgtttgtaactgtaaaagcagatgtggtataaaagtgaatacaatacatgtgaatgaattcagggagtttattagaacattattttaatactctatcatggatttcttgaatatggaggaaagaaaagcatacaagggcacatagtatactaagagtacaggagatatttaagggacaggattaacaataaggattaacagcaggcaaaaaatgggaaaaagcagatgaactgaaatatttcacacactgtaaaacaccacatattatgagaaacctccctttacaaaatggaaatgctgaatacaaggtagttcaacatgaaaagtaggattgagttcacaaaaatggaaaggaaatttgaaggatcaacagtaaaatagggcagggttcatctgaagtccagttactcaggaggctgaggtggggggttcacttgaggccaggagtcccaggctgtagtgtataatgaatgcgcctatgaataatagcactgcactccaacttgggcaatatagcaaaacctcgtctctgaaaaaatgagttaattaattaattaaataactaaattaaaaagacctgaaagtcagtcatttactctacagtgaagctaagactggctgggtgtgtttagaaatttagtaatcagggtcttgaacttttgcaggaatccaaggacaggaaacaatgctatgggactgggagaggtaggcagcaggaattaagacctcctgcataaagttcagacatttgaaagctatgcccttgtgtaatgatgagtagtataatcataggcctccatctcagatgctttaagtgcaaggtttactacctatctaaggtgataaattaatttacagttgtcccacactggtagatcccttagggtacttggcaaaagcaaacacaaaacacacacccggaatttatggcattttgatagtcttaacatttgctcactctaaaattgcaacaatatatattcaaaaatttcccatgactaagatgcaagtggaactacaaccagcattattcgagttccaggacctctatgcataaaattattggctccaagctgtagaataagtatatttaaaatattaagaaattaaatatgagaacagaaaacatactactcaagaagaccaagtacatttgaaaggaaaataaataaacctagaaaaaatagtaataattcaaattatgaatccaatgggtaaattaatagcagatgaaaggtgaatggagaattagttaactggaagaagacgaagaaattaagtttaatgcagcaaaaagagacacttggaaattatgaaagaagagacattgaggattaaaatgacagactaacgtatatctaattgggatttcagatggcaatatttgaaaaaaaaattagttgggaattttcaaaaatgcaaaatttttcatcagtttcaaaaattgatgaaagacatgcatcccaaaattcaggaagcataaaaaaatgccaagcagaataaaaaggatgtatatatatatacacacacacacatacatatatatgtgtatatatatgtatacacacacgtatatatatgcataaacatacatatatatggttttctggaagaaatcacaagcagtattaatagcttatagagaaattaaggagacaccctagtttcaaaggaggatatgtttacttttattttgtaactttctgtgcgatgtgaacttgctaactctaatattatagtcaaaaggaatttttaaaaactttttacatttaaaaaactaataagtatagtaaaaaattaacaggtaataagtgagcctatgtattggtaattaatgaagtgacaaaaggggattttcttttgtattattaatttcatttgtcttcttgtaaaagacaattttgatatggagagacaaatatttcctctttgcaactaaaaagagtatattaattaagaaggcagtatttccttcctatttctagactattgtgtatttttggactatttagggagtattgtttctataaattataacgtaacaaatattgtcagtgcttcatctatatcccctctagctcactaactagttgattgccaattgcccaaatctatatttacctgagtgccttttctggccactgaagaaggttttgcctgcctatgcatgaggccaaaattgtcatagaattaatgttactgccaacagttgttaaacagtggccagtgaagtttgatctataaaattatacttcaactcccttgctccttaatgggatgaccaaatggtatacatatggttctgatttactgtggttagacttaagattttttgactttacaatggtgagagagtgatacacgttcagcaggcaccatactttgagtatctacacaaccattctgtttttcactttcagtaaattatatgagatatgcaacactttattatagaataggtttctgttagatgattttgcccaccagtaggctaatgtaagtgttctgagcatgtataggttagctacgctatgatttttggcaggtcaggtgtattaaatgcattttccacttgtgatatttgtaacttaagatgggtctattgagacataaccccagtgtaagtagaagggcatctgtattccatagtggttatcaatgttattgctgatgggattaagcttctattgctttgagtatgcctctccttctgtgtcttattcccccacctttctaccaatgttttcttcaccagaaaatatggttcgcacactcaaatcattgtagcagagtctgcttcttcaggattactcaccaaaacaaacaaacaaaaaacacagtttgtattttcataattaagattcaagtaaaacagacagtcaacaatgattcaagtaaaatagaaaatgtatatactttcagcaaatgctataacaaagtattccaaaataatttgaaaaattgcaaagtccctaatgctaaaaaaaaattcatttaactttctatagccaacggtgccacagtgaaatgcatttcacagcaaaatatctttaagaagtaggagagagtaaccaatgtaattggttttattttataattatattctgcttttaaggtaatattaaaacagtttctggcctcaatttatttaagacctttggttaatttcggtgatgatcactgttcactgaactttgaaagataccatgaaacagaggctttggattacaatttctgtcattcctagggctaaaagattacttttcttccttcctaaataatttgcaattcatttcggtaaatactagaattactgagaaagaatggctgctttttctgtgtgtgtgtcatgtgtgtatgtgtatgtgtgtgttaattaaaagctttctttatcttttgcaataacgacatcataggcccatctcgaaaaatattatttcccattgattcctaacattaggctgatcatttgtgacaatctgtcagattattataactatggcagatggcctcagactttttaatcagaaaatccaaactgaaggttctggattttctttatattccattcttaggtatgaagtgctgcagaacagatgggaacatacctacttgttgaataaatacggttttagtttcttttttaaaaaaattacattacaactttatacccataatagtggtttttaaccaaaggtgactgtatcttcccagggcacatttgttaatgtctgcaaacattttctattattatgacttagggggaggggtacaattagatctggagaatagaggctaaggatgctgctaagcatcctacaacacagaggaaagactcctgaaataaagaattatctgactcaaaatgtatcgactgtgggtcaggaaaccctggtctacatattagaaaaaaaatgcacttttttcttttaaagttattaaaatattcagatatactttttgcaggaaacttttgaagccagaaatctttaacaactatttttcaaaataggagaaattaggtcgttatcaatataaagccaaatactaaattatctttgtttacttttagttctcaaacagatgttctacgaacatacaagcaagaaagatatgtgacttggcagatctttctaatttaggaccaacccaggttttgataatatctactttatttgtagcaaacacatgaaccatgtatgaataaaatagacttctggggacaagttattaaataggatttttacatcgaagtaggggtttcagaataacttttccttccctttcttttcgtcttcttttttgtttgcttgtttgtttgtttttgagacagggtcttgttctgccacccaggcaagagtacagtggtgctatttgcagcctgaaactcctgggctcaagccatcctcttggctcagcctctcaggtaactgggactatgggcacacgccaccatgcctggctaatttttgaaaaaaaaaaaaaatgtgcagagacagggtctgactttgttgcccaggtcttgaacacccggcttgtacacccggcttcaagcaatcccacccagccttccaaagtgttgagattacaggcatgagccactgcacctggcctccctttatctcctgactttgtgaagtgttttgcacagcatatacttctattggctcatacccagcatgtaacttttgatcctctgtgatatttcattgcttcataattctccctataaatttttttttttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgctccctataaaattaaagctctcattgtattggttatccattgctgtctaaaaaaacatactctaaactcagtggcttaaaacaataaacatttattttttcacattgtttctgtgggtcaggaatatgggaaatggtttccctgggtgattctggctcacagtttttcacgaggatgcagtcaagagcctagatggggctatagtcatctgaaggattgactggagctagagaattcatttccatgtggctcactcacatgcttagcatgttagagctggctgtcggctgaagaccttaatttattgtcacatggatctctgtatagggctgcttgagtaaactcaaaatgtcacagctggcgtctaccacagatagtgatcaaagagagagaaaggcaaaagcaagactagagcttatgatcttgccacgaaagtcatgcattttcatttctgcagtattctattggttatataggtcagccttattcagtgtgggaagaaactatatgaagacagtgttatagactaaatataccatcataatgtgatggtattaaaaggtgggcccattgggaggaaatcagatcatgagatggagccctcatgaatacgattagttttcttacaagaagagacatggtaactggatttctgtctctgttctctgccatgtgaggatacaatgaaaagatatacatctgtaaaccaggaagcaggccctcaccagacatcagatctgcagtctccttgatcttgaacttccccagacccagactatgaaaaacaagtgttggctgtttaagtcactcaatcgatggcaatttgttatagcagccttaatttagacagacacagaaacccaaagacgtgcattgttgagggcatttgtgattctggttcccacactcatattctgatagacttgatgaaatattttactacaattagccaacatttgtacttccttctatatatcacagaatacattcataaattatttagttgtgttttgtaatacttcttcaacccaatgactgatgacttgaaaaggaaagatactagaagtagagaaatcaatgaggaaattaatacaatgatgcattcagaggaggatgaggactaggcctatgaaaacaaaaatagacattgagtggtgggtgaagaataaggaaacttaacattgaataaatacactttggatgtaagttagaaatattaactggaggtgattccaaggatttttgcctctgctcaaagaaagaacatgcccttgagtaagacagcaaaacatatgggtgaagaatatttttaaataatgaatctagtttttatcctatgaccttgatatgtcagacaaagagatttggataaaaatatccagaaaggagttggaaacttggatgtgtaataagggaaagggcacctaattagagaccttgtttgggaattaacttctaataccgaccattaaggtgaatgaaaggaagagtgagggagagaaataggagagagaaagatgagataatattaacattgaacaaagtggacttttctgaaaggtggatgaactacttcctggtggcacattatagaattgatgaagtaaatactcttttctaattaaaagagcttgatatattgaaaatgacattacattaggtgtcaaagctatctctggtactagctagcagactgatctttggcatatcatttaatttcacttattctaatttttcaaacccattagagacttaacctaggaaatcaccacagaacttctaggtgaaaaagttaatgataccaattatgtttatatttttgtatgtgaatattactattttcattcataggattgatataagaataaaataagataaagtatgtaaaagtgctttataaattgctcttaatttagagtctgcacagtgttgaaaattaataaggatgttatacatttatttgtgcatagatttatagaaacattggtatatttctcagaatatattgtcaatgtgacaatttctattcacatgagaatatgaacttcatattcatatgattcagttaatatgagaatagtttctgaaaattatagtcttcatttattttcttttaattgtcctaagttgaactgtgatctctgaatgtaaatattaatcttaatacttctaaaagtgttttatttgtttataagaaataattatatttctaagctgacgaatttctaaaagaaatttattcttctcttcttcctcgactctgccatctaccattcttagcttccatttagtttgatttcaaaaactagagactaaatacatagagctttatttctgttggcactattaacccagtacaattcattaaaaatatatatgaaaatatggataaccactaaagaagcataatgacttggttaatcataactaagctttatatggcgagaaacaattaatggctttgtttttgaagaaagtgttaaattgtgtgagaaggaagttttttatcatttttttatcatttagaaataggaatccacttagtgaaatatgtcttccaaagcccaacatagaacctgacaccccaaatctgttcatgtttctagtacataggaaagggctttcttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttttttttttgtatttttagtagagacggggtttcaccgttttagccgggatggtctcgatctcttgacctcgtgatccgcccgcctcggcctcccaaagtgctgggattacaggcgtgagccaccgctcccggccagggctttctttctgtagaagcaggtacagttttgcctgcctccatggtgtgatacattcagggttataatttaaacaatcatcaggttcaaaagtgagccaaagcatttatttcatccctgttaaatattaatttaatatggagttgctgaatctgatttctccaacgccttcctctcatccattgctataagtcatagggaattctagaattagactatcttagacaaacaataggaattcagaagtcacagaaataggtaaaatgtaggaataatctcctttccctactctgggaccccagtaagggagatgatatgtccacatgggtagagactctgaattatattaaaatgcatttgttgtagatgctggtctataattgattcagggctgccagttaaagagtgtgtgtgtgtgtgtgtgtgtgtgtgtgtgtgtgtgtgtgtgtgtacttaatttacatctgaaacatagttttttttacactattatggcaaaatcatggcctttcctgtcagtttattgggtctgttggctctagcattttctgtgttgtttaatatgtgagcattatctctttattgaattttggtctccttgtgaaaaaagtagttaatctcttgaaaatgttgtcaaatggcaccaaatgtccccttatgccggtggagacaaatatgagttcacatcctgtaaaggaaatgggctttttagaaattgagctgagcaatttatatactttttgcatttttcgctcgcacattatctctggtcatttgctgtcttgcaaaataaacatcactttgttcttgaaaatgataaattatatcttttaatgcttttatgacaactgagactatacacagaacaaacgagtaaatgaacaaacgtacaatggttacagttgatgttaaatcaactgcaaaatctacagcaatgtttcaaaagctaatagcagtttccactgatggctgaaatgccttaaatttatactaggcctgacgagaaagaatcactaataactagtgtatcataattttaattacctatagaatgccttcaaactcttcaatgttaggtttttcatataaaaactattttactagttgtcaagatgcgtctttagctcccagaatacttccatgttttatcagtttatccagtagatatgatgtctatattttcagaagcttaatttttgcaaatttcataattctggtataaagaattaatgacaaaattcaagttttataaaacacagcaaacatcaaaatagaagaatccccaaagacaaaccttatacagtgcttcaagcaccataatatgaataaagtcataaaatagaaaatgaaacctttataatggaccaccctctctattagcaaataaggttgtgaatagagactagataataagggtagggctttttttatttgctttttctctctagagaattctgagaaattataaagccttcaacattttccttgcaggcattgtagtcacagcagctttatgtgctccattactgggactgatttcatatgcagatgcagtctctggggcaaaatttcttatgtgagataagaatagctacttctacaaatttgttcaccgccctgcaggagaaaatgaaacatatgtcctaactttcatgtttcagatctttggtgatctggaaagaggcatttcccctccaaaaggggctatccaggaaatcatttttagtttgcttcattgaaagtgcatctcccttgggccaatcagggcttcagaaacatctgcttcgacatcagaagaggtccacaaaggaaacctactctgctattaacttacgttttaaaagaatatcaaatctcatttattttacttacaaaatgtatctttataattataatagtgagggcattttcatgaacatttagaaaataggtacttcattatttaaatgttcacagttagtaattaatttatggaatatttagtttgatttctttttgaatttttaaaattacagtaaaatattcataacactaaatgtactactttaaccattttttattgtacaattctgtggcattaggtacattaacattgttgtgcaacaccatccatcttcagagattttcaccttgcaaaactgaaactgtaccagttaaacaataatttcccatcccttcatcacctcagtccctggcaaccatcattctagtttttgtctctagtaatttgactattctaggtacttcatataagtgaaatcatgcagtcagcatttatccttttggtggatgatttatttcacttagcataatgtccatgttgtagcacgcatcacaatttccttacttttaaggctgaataatttttcattgtatgtacataccacgttttgtttatccatatttattcatcaatgaacacatggggtgcttccacttttggactattgtgaataatgttgctatgaacgcgggtgtacaaatagctcagactgccttcaattattttgggtttatacccaaagatggaattgctgggtaatatggtaattatatgtttaatgggtttgaggaaacaccatactgttgttcatagaggctgctccattttaccttcccaccagtaaagcacaagggttccaatttcctcacatccttattaacacttgttattttctgtgccgttttttaaagccatcaaactgagggtgttgatttcttttttctttttactacaaattatagtgcagtaaataatcttttacttaaattttatctctttaggtttttgttttttgtttgttttgttttttgtttgcttttgagacaaatctcactctgtcacccaggctggagtgcaatggctcactgcaacccctgcctcctgggttcaagagattatcgtgcctcagcctcccgagtagctggaattacaggcacatgccaccacgcacagctaatttttgtattttcagtagagacaaggtttcgccatgttggccaggctggtctcgaactcccgtcctcaggtgatttgtccacctcgtcctcccaaagtgccgggattacaggtgtgagccatagcacctggccttatgtctttagtttcttaggctacatattcagatagaaatatactagcataaaggcaaagctaattgtatgatttttattttttaacaactttattgagttataattgacatacaaaaactgcacacgcataatatatacaaattgatagtttgaacataggcatacatgtgcttgattgttataccaagactacaattaaggtaataaaaatatccattacctccaaaacttttcttgtgtcagagtgtgtgtgtgtgtgtgtgtgtgtgtgtgtgtgtgtgtaagaatgcttaacatgagacctaaccccttaacatatttttaagtgcacaatatcacattgttaactatgggcagtatgttgtacagcacatctctagaactgatttatcttgcctaacttaagctttataccagctccccatttattccttcccccagctcctggcaaccatcatcctattgcctgctgctattagtttgactattgttaataccttatataaatggaatcatacagtttttgtctttcggaaactggactgtttcatttagcctaaggttttccaggttcatctatgttgttacaaatgttagaatttccttattttcttaaggctgaataataagtcttggcatattattttacaaagttatcactctaatttatactcctactagcattgtgaaaaagccactatcaccaaatgctgccaatattgattattactgtttgggtaattctactgttgaagaactatgctattttaatttcccgattattattaggtaaacttgggttatttataacttctggccatttatctgtgtctgtgtgtgtatttctgtaaattgtctcttcatgccatttgttcattgttttctgtgggttagattgttttttcttattgttaataacaggctttttattaatcaccttatgtgcaattttttatttttaatttttaaaatgagtttaccatgtagaaattcccaattaccctgatttgactaatcactctcctaatcactctccacattgtaagcttgtatcaaaaaaaatgtaccccacaaatatgtattattatgaatccataataattaaacattttttaaaaaagaaattcaaagtcttatgtattcaaatatgtttgatgttttccctttgggtcatttctcactgtccaccataattattaatgtttgtcctaattgtattattctttttttcttttttgagatggagtctcgctcttattgctcaggctggagtttgcaatggctcgatttcagctcaccccaatctctgcctcccgggttcaagcaattctcctgcctcagcctcccgagtagctggggtcacaggcatgaccaccatgcctggctaatttcgtattttagtagagacagggtttctccattttgatcaggctggtcacgaactcccgacctagatgatctgcccgcctcggcctcccaaagtgctgagattacaggcgtgagccactgtgcccagccacttctgttattctttaggtattgactttacatttaactactaaattgatgtgtaaaattccataaatatgcattttttgttagcatagtctataaggaagcatctttcagtgttaaaaatattcatcctttctttgcaagcaaacatatgatggggcctttattatataccaaattcttaggtacacagaggtttcttaggctcttcattctatttcattaatattattgttgatttctgtatgactatcagtgttaatcactgtagtttcttttcttctagtattttttaaaaacacattttgtcaccattgctgcccacgtttgaaattatcttgactgttgttggattttatttatcaaaatgaactttttttgtcatcttttattttagattgaggggttgcatgtacaggtttggtacataggtaagttgcatgtcaccggaattggtttagaaatgatttcatcaccctggtagtgagcagagtacactataggtaattttttgactcaccctccttctaccctccccctggcaagtaggccctagtatctattattcccatgtttgtgtccatgtatactcaacatttagctcccatttttaagtaagaatgcacagaatgtggttttccatttctgcattaattgcttaggataatggcctccagctgcatccatgtaaaggacatgatttctttttttatgggtacatagtatttcatggtgtatatgtaccacattttctttatccaagccagtgttgatgggcatctagattgattccatgtctttgttattgtgaatagtgctgtgatgaacatatgggtgcatgtgtctttttagaagaatgatttatattcctttgcatatatacccagtaatgggattcttgggtcaaatggtagttctgttttaagttctttgagagatctccatgctgctttccacagtggctgaactaatttacattctcaccaccagcattccctttcctccagatccccattgccagcatctgttttgttttgtttttttttgttttaactttttaataataataattctgactggtgtgagatagtatctcattgtggtttgaatttgcatttctctaacgattagagtattagtctgttctcacattgcttaaagaaatactgaagactgggtaatttataaagaaaagaggtttagttggctcacagttctgcaggctgtacaagaagcgtgaatgctggcacctgcttcacttctgagaggcctcagcaaactttcaaccatggcggaaggtgaaaggagagcacacacatcacacggccagagtaggagcaagagagagacagaaaaggtgcaacacacttttaaacaaccagatctgagaattcactcaccgtcacaagaacagcagcaaggagatggtgctaaaccattcatgaaagatctaccgccatgatccaatcacctcccactaggccccaactccagcattggagattccaattccacgtgagatttgggtgaggagatagatccaaaccttatcaattagcgatgttgagtattttttcgtatgctttttggccacatgtatgacttcttttgagaaagatgaactttacaattactatttactccaggaaaaaaaaaaacctggtatgtatatattgaaattgcataaagtaatttagcaatagctgatatctttcttatatcaaacttccaaatctcataacttagagattgttatctgatggttaccacttcatttctcaatgttttaaaattacatattttgcattggctttatttattttctatttatttaattataaatgtatacctagtgttcacatgtcaaacttttctctctgtatttataacatcaatggcttcatattcaactgtttttatatttttctaataagtgttaaagattattgatcgttgtgatcacttattcatctttattattagatgtgcctacatgatagttagtattcaatatttaccaagttaaaaaattccaatgtaaattttttataattgaggagaaattgttataaacatatctatgggattctttattataaatcataaacatattttatattaattatgatgaaaaatctcttaatagtcaatgtttctatatatatttttctaagttgaaaaattgatctatgagaaaaaaatttttaaagaaagaatgtatgagatacttttatgatgaaattatctttttctagtcttctatgtatcaaaaaattcatgaatattaaaattttatatatttattaggcaaatttattgtatattaatggatttcttcatttcacatataactattatttttgattttttaaaaagtaaaatacattgaaaagatttctctttttacttaccataaatacttctacgtagccaaaaaatcttgatatatttcagtatagtcagtagatttggagttaaagaatgtgattccacaaatattgaccttactttagcattaatttttttgcatagttttctcaaagtaatggaagtttagaacaaataatttaaatcacacaatctagaattggttgtgaatcctaccgaagattcaattttcatgctatgtgtagtccttgaagtagaagagagatttcaaagaagttgtgggtaatgataaagctcaaaagttagactgaaacaatcatttgtcagtttccagttgataacattagccctttgcctcagaaacactggtaaatgtggcttcactgtcagaattaaccttgctctttaaactatactcttgactttagataaacagaaaataaattctgtaatttcatgtactaaatggtttcattaagatcacattttgagcaaacctaggattaaaccagattatggcaattgcaattaaaatataattcttgaaattttattattttctattagcaaactaaatatttggtttggcttctgagtgcaacattatttaaactctacttaaaattatgatttaactatgattcttttatttattaaatagatctttaaatataatagagggtgattcaactaagaattgaaaacaaaatagttttattaaaaaatgtatgatgaaaagttggttattttttcaagtttttatgctctggttacataaagatcacagaattaagtgtcaatgcaataggtaaaataatgaacatgtggaatagtggtatgaatcaccactattcaaagccagcttctaacatttgtctttgacaaatgccatagtgacaagaaagtgaaatttaagattagaataatataaattatatgtcagttttcaaaaatgttgcttatttacgttatttaattttcaagatacttgaaattaatcactgctatagatattgcaagtaatcatacagatacttttagattaaagttaagaagaggactcactgaaatatttcttatttagaatttaactgccacaaataaaactgaaaatgcaaacgtttactgaaaataaactggatataaataaatagaaggaaaagcttcaggtagtacttctagatagtaggaactattagccaacattaataaatcaggtgagacaaaattacatggggaaaagtgaatgtctgggtgtgaataccagagatatttctagataaacataatcagaattttgcttagaaaagtgtttccctaaggaccctttcttgagacacagcttcttgaaaaaaaagataaatatctagttaaactcatttatcatcacaagttattatgaaatggcagcccactggtgaccttacagactcactgccttaagtcccagccaagggatcaacacaattgatgatttaataattaactattctttggttacaaatatctttgcaattaattttccagagtaggctgctctacaggtgattgctttcaaatccattaaatgggccaggcgcagtggctcatgcctgtaatcccagcactttgggaggccgaggcaggcagatcacctgaggtcaggagtttgagaccggcctggctaacatagtgaaaccccatctctacaaaaataccaaaaaaaaaaaaaaatatatatatatatatatatatatatatatattgccaggaattatggcaggtgcctgtaatcgcagctactcaggaggctgaggcaggagaatcacttgaatccaggaggcagaggttgcagtgagccgagatcgcaccattgcactccagcctgggcaacagaatgagagtccatctcaaaaaaatcaaaacaaaaataaaacaaaacaaaacaaaaccattaaatggattatgataggctatgtgtttgaaagcataaaggagtggcatgcttgggatgctgaggttgattatattctagaaaatttgtttgtaagtcaactgattgaaataaaagtacttttaaatttaaatatcatattcttagataaggcttcaaaaacaatgcattttatataacaaattaacaacgtagaataaattgtccttaatgatatcttttcttatcaaactaaggtataaaatattacacatgggaagtctgccgacacctttttaatgaaactgtgaactcactgtccttagttcaagaggtctatccctgagttcacaatcacatggactagagttggagatcacttttgaccatacccatcgctaattacctaaatacgccagtagtacttagaaaggggaaggtgaaaaacctgtaaagaggctttcagtctcatgactttcaacctcaagattcctatctctgtcgactcctagacagtctaaatgactccatgttgccacaaagattgcatgccaattgttatatatatcctatggtgtcaagccagtttgtgattgcctctatgatgttagctcttgaaacacggagaacttattaggtggttttgccttatgacaaacatatgattccgtttgccaatatatcctgatatattgttggacaactagcatttataatggcccaaggtcttttgcaaatgagtttagaaggaaaataacaacctcaatattaacataagaaccatcatttgattaggatactgaatagtcctgccaagtatggtcttcttatttaaactcaggttacatgtttcttgcacattacttatcagatatttcacacacatctcactggtttacatttattctaaatccttttattgtaaatgatcactcctagattacaggatatttaaagaatagctaatatatttattttgatcccttttcagctcctcattcatattgttaaagtaagaaaatgtctatgatgtcttaaagtcatctctccttctaagtccttattccttgaatgttctccctgactgatactcttttatgctgagctgtttccttgttggagcttctgttgtcctcaacccattgttttctacaacaaaactgcactcagatctttcattttctggctacaaggagaggtgttctttattcattcaactttcaacaagaattaattaaggaccaattatatgccagcaactcttctaggtttttctgtgaacagaaaacccaaagatctattcctgttggaacttactttggggtgatactgataataaaatgaaaatactatataataaaatatacaataattttgaaagttatattaaaaatcatgtggaaagttaacatgtgttgtagcagggttacagttttaaacaaggtggttaaagtagatttcgttaatgtgtatttaagtaaagaattaatacatctagactaattaatgttcctggctaagggaacaggcagtgcagacacatgcttggtatgtttgagaaacagtaaaaaagctgatgtgactggaggaaagtaaccacaagggaagaattgcacacacagtggttagagacgttatgaagaaccagataatgtaggtcatcataatgactggctttggttgcgaataaaatgggattctggtacaaggtttggggcagaggaataatatgttctgatatttttaaattgaattttctgaaaccccaaaaaacaatgaatgtacagtgtacccctgtttacttctccttatgttcatgaactattgatttcttcccacaattgctgtttatacacagaaacatacatgcacatgcatgtacacacacccacacactttcccaaatcattaaaagaagttttctgtaaatatcatggcactcctccttaaccatttcaatttgcattttctagaaacaaagaccttctcttactctgccacatcatcattaccatacctaagacaataaacattaatgcagtggcagttttgaaatttcccccattttcaaatttcccagattttcttcaaaatgtcctttttagctttgtggttgttctttaatcctgtgtaaaccaaaccccactcgttgcattggctaaactgtttctccctgttctccaccaatctgagtcctctgcctgcctctgttctcaatggcatttaatcttgaattcaggtcaattgtactgtagatcactccttattctggatttgagtgatagcctcctgattattatattcagttcataatatcagaatatattttgcttgtttcatatatttattgcttggctaggcagaaaagtcaaacatatttaccaagtccacatgacattcacttgtttaatctctataaggataaacgtttgaaccaatagagttatttctgaaagtcatctttagtttaagtgatagatgagaatattggttcaataccctgtgagtttgtcgtggagagttgtgtcttatttacctacttcatttatcccatagggaaggcagttgatttctacattttgcaaaattctagttagatgtattattgataaaattgctgttcagatctgatgacaatttaatatagaacaaaactagattgagtgacctttgctgcaactgatgctggcctttcttcttgttaagtgactggtcaatttatctaacttataggaaatattgtgattgctaaatggactgtcatagttaaagatatacaccattcatcttgaaaaggttcaccaggcaataataatgagagaaggtcaaggggcatgagacttcaaacagcttttaaaattcactgcccttccacacatatgtagttgtatttttttcacttttagctatttacttagagtccactgtcactgaattgacactgtgtacactcaaaggtgagaatatgttttgccaaataattataaagtcaaactgtttagatttgtgtacaggataaaaaataatttttgtatattctttgagatgggaattcagactcagataattatttttatgctaagttgctcaggttctgacctatttttaaggaaaattggatttattttctgatagtgctgtacatgttcagggtatgtacaggctgcaatggacagaactagagggccataaccagtttggaaagaagatggaataccactactgtatacttacatgaaactactcaagggaaccagcttgtttcccaggaaatccaagcaggggaaatgcatagtaatctcacttagtgacagaatgtgtgactaaaatgaatgaagaaaatgtaattcaaaaataaaatttaagttggcgatagtcaaagttttttctctacaaattattatacaaaccatatatattttaactattcatatttatttgaactagtctaagcaacttccaaggaaggaaacatttgttgcttttgacctgtacaatttgttattcttcataggcacctggtaacctatcgtactggtaagaaatgctattcagctggatatcacctagtatatctcattaacacatgccaaagctggacaagtcttttctagatttttgtaattttaaagcatattcataattctatgagaaagtatcctaagatagcaaacttaaatattcgcatcacaagttcatgtatgtatgagcaacagcatgatgaaataaagtttatttttctcctttatagtgaacttttaaataagtccctgaactactttctgtgaatgaacctatatttttctataccttatttacacattttccagtatcagtttctctcaaaaatgaattttcatttttggtagattttttgaattatcacttttaataaaaagatttatacatttcttatgccacatatttttaagtatttaatcagtgtctactatatcttccttatctctcaggtttgtcattaagagtttctatactgttacagattttaaaccatttctacttacattagagtttgacagattagcctcttaaaatccatatcctaatttttcatagtttttccttataatttaatgaattataaaattcacttcaattttaaaatattgttttattcaaattactgtattttccaagggctgaaattgaataaattgacttattgaagtcttccaagtaatataatcctaatataatccattagtttactaaattggctcattccataattactaaaaattatgataaaaccagaatttaggttttaaaaatattttaaattattgatctgattatgctttcatgagaaactaaggtaattgtagtttcattctcatccctttactttttttttttttttttttgagacggagtctcgttctttcacccaggccggactgcagtggcgctatctcggctccgcctcctgggttcacattattctcctgcctcagcctcccgagtagctgggacaacaggcgcctgccaccacgcctggctaattttttgtatttttggtagagacggggtttcaccgtgttagccaggatggtctcgatctcctgacctcgtgatccacccgcctcggcctcccaaagtgctgggatcacaggcatgagccaccatgcccggtctttacttttaaatttatctatttttatactatagactatttgtaaataccattaatttaatttcagttggtattttatgacagctgtgttgtcaagcactgaccctgtcaagttcgtactctttctaccttagtgtgagtcatttaatttaaggtaggattgaataattgggctatataaaatttggtttcttagaacaatacattggtaattatgaagatttgcaggatttatttacattctttttctgatttttgattggaagaaaggaaaaacagagaaaggatgatgcaacttaataatataatggatagctgatcaaacagtttgagttcttttaagagttttacaaaatattacttacttatccccatttaatactaatcatagtcttactttaactactccacagaggaattttagattatagctccaactaatatgtttttatataacatatcacctttaaatcctgaggaaatgagcaataaataagagctttgagaaaagctagagcaggaatctaaatatcattttcctagaaaggcaggaaccgtatttaataaccagctacaaatattgctataatcattaagggaaatgacattcaaagaatgagttattgtgattaaaaaaactaacctaatttcttactgtttaagttataaacactaagaagtcttattaattcatctacttcattttttgagttgattgttttaaggcattatgctaagatttaggtatatgtaaaatacatatacacagatatatctatatgtatttatgtgtatgtgtatatagatgtgtatatatgtgtacatggatatatatgcatatacatttagatatacatgcacagataaaacaatgtaaaactattttgatgtatgtaaacacaatgaagagagcatctaacttagttcagtcaagatatggacagcaaagtattaccctgagaagtgatattttagctaagacctgaaaattgaaaagagttggtaaggtagatgaggacagagatgacagaaggcatcccaggtggaggaagcagcatttgaatatgtcaggctgcaggatgatttggttaccagtgggatggaagtacagtttatattaagggaatacttggaaaagaagaaagaaaaacaatttggaatggcctttagtgctatggcaaagtgtggggggttgttagcttttgtctttttctggtcagtgatagggacccaataaagaattttaagcaatgaaatgactttttagtttatacgttagaaatacaattatgtttgcttaggattgtttggctattggggctcttttattggttccatatgaattttacaatttttttaattctgtgaaaaatgacataggtaacgtgaaagtaactgtgttgaatctgtagatttctttggtcaatatggtcattataatgatgttgattgtctaattcatgagaatggaatgtttttccgtttgtttgtgtcatctataatttttttcatgaatattttgtagtttgtagagatctttcaccttcatatgggacttaaataaattaaagagtttctgcacagcaaaagaaacaatcaacagagtaagcagacaacttccagaatgggagaaaatatttgcaaactatgtatctaacaaaggattaatatccagaacttataaggaacttaaacaaatcaacaagaataaaacaaataacctgatttattgaaaagtgggcaaaggacacgaacagacatttctcagaagaagacacctgagcggccagcaaacatataaaaatgctccatatcactaatcagcagataaatgcaaattaaagccataagataccatctcataccagtcagaatggctgttactaaagtcaaaaataataaatcatagctaggatgaataagaaaggaaccgcctagacattgctggtggaaatgtaaattaattcaacacctatgaaaatcagtatgggggtgtctcaaataactaacaatatcattaccattcaacctagcaatcccactaatggatacctgcccaaagaaaccattttatcaaaaagacacatgtacttgtatgtttatcacagcactatttacaatcctaagttagggaacctaagtgtctatgaacagtagcttggataaaaaaatgtggtaggtatacaccatggaatactatgcagcgataaaaagcatggaattatggcctttgcagcaacatgattgaaactggaggccatcatccaaagtgaattaatgcagaaaaagaaaataaaattctacatgttctcagttataagtggtatacagttggtacagatgaacataaagatggaaataatagacagtgagtactccaaaaggggggaaggagggaggcaggcaagtgttgaagagactacttattgggtactatgtccactatttgggtgataggttctctaggagcccaaaccccagcatcacccaacatactcatgtaacaaacctgcacgtgtacccccaaatctaaaataaaaccttaaagaaagaaagaaaggaatgcaattctgatatcaaaatagcagtttaaaagagagtttgtgacaagattaaagggttgttagaaattgacatttgcaagtcacttggaaggtatttgcaaccatagatggtaaatgataagaagtactacaaactgtcattcacatgttaacacagcctcctcttgaaaacactatacatgtagatatatacacacacaatgtatgcattacatatatatacattgtatgtatgtataatatacacatatacatacatataatgaaatgatgccctttatgaaaaaagatatgcatgatgaaaacatctttatgaaataaagctctaagaaagtatgttactgtataagtgattctatttgcaaagatgttatatattgaccagaattttggtggtggatgacatgatatgtatttcaaccttcagttaacagatgttggatttccctttcccacagaagaagtattgatttttatatctgtttaaccactaatgaatatgtgttaatgaaaacccagggcaaattctgtatttcaaaatgaatttgcttttttaaaaattgaatataaagatctaaaaagatgtttgatgtaatcaaagttgtcttcaagttttagaaacagcagttaatcttcgggctgttctaaaaattttttgtttgttttacatatttatacttttgggtttgacatatttatagcttatcagcatcttagcaatatgtttgtattcgatttataaaaattataattatatataaatatataaattataatttataatttataaatattatagccagtaatttttatttgtgttttaaaatatgtaacattagtagataattattatgccctgtggtatgataatggatttttaaaatgttcttaaaagcaaattttaagattttatttttattttctatcataacaaatttaaacctcacaaattattttcagttaaaagtaattattttgattatatggttttaaactggttgtttgctgatattattaacatagtatgtgctaaagcctctggtacaacatgaaagctgtaataaaatttactgtaaaccatccatgaagggcacttttacagatgttgtgattatgtgagcctagaggctatattgctgtaattggcatcctgtgaggctggtgttctgcaattgttcctggaagctcagcgaacaagaagattggatttcacaacgtttacatttgttggctgttactttgcgttcacataatgaggaacattcacataatgaggaacattcacataatgaggaacagccattcttacttgccatactgttctttataatcaaatgcaaaaatacatcctatttcttttttttgcccactacagatttgttttctttaatatttttgaagcactatctattaaacgttactgaatgttctttcttacaacaaacattatatttattcttgcctcagtgcaaatgtacttaactttacttgtatccatctaaatctcccaaatatcattccattaatttttgaatcttccagtttggaagttcattttattacaattctttcagtggatacaatgggcattttattggaaatatttatcagaacaaatcctaaggtgtctatcatcatctttctcttctttcccaataagtaccttgagatgctttaaatctaaccacccctcccaacttgtgtaatattgcttctcatattttgtttgtgtatatttgtatcacttaatattagatattcttatcaattccttatacagtcaatggtgacttagatccactcacatatatgtactgtttctccaaacttctttaggtcactaacttctctatgcaacatagtctttaggagttctattaatgagaatatgcagtttgtaaactatctcaatttgttgatatttgaaatgtctttagttcactattgttatgaaagactgctttgcccagcataaaattctaggttgacagatatttttctcatagcattttgagaaactttaataaatttcttgtatctggcattctgctctctaggtgtgattaggtaatcgtgtgtgtgtatatgtgtatgtgtatacacctctctagaaattcgcttggctttctgaatatgagaactgatatctttcatgaattctgaaaaatttagttattatttcttctattgccttcccttattctttctatattctctgcacagaacactgattagatatgttagatcttctcactctttctgtccttgtcacatattcatatgtctgtgtgccacactgtgaatgatttctacagattaatatctttcaacttattatctcttctcctgtatctcatctgctgtttaatattctcaatgaatttctaaacaaccataccttttagttgtgatcatttcattggttctttttcaaattacatggtcatttttgcctcttcctttagcatactttcactacatattgatattcttttaaacaaataaatcttcttaggctatatttattgttgtataattctgctgtttttgcccgcttcaactgtaatgtgttttttttactgactttcactcatggttgctcctttcctgttgaattcgtgtttcttggaacattagctattggaattctttgacgtcttttggcttattttctccagagataatttgtgtttactttctccaggtccctggatccttaccagaaggggcaatttaaagctaatttttttacttaagttttttttgaccaggcttagcaaactacagcctgcagaacaatttcagcctgctgcctgctttcatgaataaagttttactggcacacagctacatatatgttttgtccttggctgctttcccattacaatggcagaattgagtggttgcaacagaggccatgtggctcacagagcctaaaatatttactatccggtcatctacagaaaaactttgataaccactagtttaagccatatcatccattcctttaaagataggattgtggctttgaactctcataggatactttttgcttattcccttccaaatagaaacaatgataagacagaaaattatctttgccctctgtctgtagttacggatacattcacgttgtgggagtcctggcatcctatagaagtccttaattttactccccattttgagctgctttggggttttgtcatatgttcagtacactcgtaacttttacagccaaaccctgcaccagccaagatgaacaaaaatatacctctggcaaatgcagatttcagcatttacttttctcactgcattcatgctttcttatttttttctgcatctgagttcctctgatatcagctcggccatgcattaagaaaataaacatgttatattttatctagcatttaaaggttttctacgctaagaggatttctctagacatcagttccaccatattaccaaatatagagcataacctattttagggattatctcaaactacacttcttccctcaagatagtgtagtttaagtctactggttttgaattcagcctgctgcaaacagttcagtttccaccattttctctatatgtgacttttcgtttttactcaatcactattaggttcctatttccccaattaaagataatgcacttatttattaggggctttgtgatgattaaagtgaaacattatatatatatatatatatatatatatatgaatgcatatgtatatataatgttagcacagtgctcaaaaacagtaagtggtcaataaaaaattttataatcattattattattattactaaattggcctattccatttttaattaagcctatgttccagtcatttattctagaatctgaacattagtaattaacacttgactagcctttgagggtaagagaataattatcaaatattcatgtattacagacactttataaaagcccattaaagatatttactctaaatcataagtcatgttacaatggacaaagggaatacaaatataacattctggagaatcaaaaaacagaacttataatctgtcagttacttttcttaaatacctctaatatcaatcaacttactcattttggggagttttatatggtagttatttagaggattaaatatgagttagtattacttaaataatgagtaagtatccagaagatctgaatttaagtcccaggatttacagggctagatctgtaacttgggtgaggcagttcctcactgcttctctttttttcattgataagatgagatcagtaatacttcctttcttattgtgttgtgaaagtatacaaaggtattctgaaagtatgtagcattgctaaatgccttaacatttgttgttattggtgttttggaaaagctgagcgtcatgcatccatatcatagatctcattctggttacagtcattaaatatgtgccaaccaatatggttaaacatgaaaatagatctgataaataccaagttttgtctaaatagtatttccaaactctaattacaatgctgttctaccattgtgcttttagtatcttttcagtacttttgtgaaacagtaaccttcacgtttgcagtggctttatatttaaaaatacatatatagagatcaataaatgtttactaagcacacactagatgtaaaacattatgccagaagttaaaaagaatatctatttaattagacacactatggccttaagaaacttatgtgctctgcttgcacaccagagatgaataaaatctaaactcacttgatgccagaattcagcatgcaataactaaagaacatgttatttccttaaaaataatctcaaaaccctagaaacaacttcaggctaaaaatgtcctctttaaaacaaaatgctgttttgatttaatttctcacttgctgttgcctactgtacttctttgattattgcctttcctttctgtattttcaactctgtagttctggaggctgcttttctccagtatataaatattctcagcttactgcagagcttaataaaccgatagaaacaagcaaatccatgcaacctacttgccctatctaatcacatctctctcctttttctttatgatcaggtttactaaatgaacattttttttttcttgtcctgtgatttgctttctgtccccgtgattttactaaagcctttcttgttcaggtcactgaggacctgttaattaccaaacaagtgcattagacacttctcagaaaaaagtgtattagacacttctcagagaatttctctccccacttctccaagatatttcagttactccccaagtatttcccacattctttctctcctcctcttctccactctcaccaccttagacttggactactgcttatcacgcctgacttttctatacacatccagtcttgaccctagaagtcaccttccaaaatgtttggtcatctttgtatgcacaacatttattacctcgttgctctcctcaaaatgtttaaattaatagatttatgagtaattaagaagatgggatttccaggcttttagtaacataatagatgtggaagggacagaaagagaaagtataaaaggacccaggatgaataacctggtacattctgcaaataaagaaactggaatatagtgacatttaaaagcagatgcaatgataatgttgctatgagataagtgtcttttattatcattaagtagatttttagctgaaacttagaaatataagtgcacatgaaaattgtgttttcaaagtggcaatcttttcagaactacttttagaatgtatacggcgtatttttccttgcctttctctaaaagttgttattgacacaaaattacacattaattccttttggctttattttaaattatttaagtgaatacatctagatctgtttctaagcagtatttctttgaaatttaaacttatcaaaagttatgtctaacttcatactaaaacaagcaaaatgaacaacccttcccctggtctgctctgagccagtgactgtgcacagcaggaacactagagccaagactttctgctcaacatgaggtacttccagctggcatttttggtccaaagacttcccatcatcttgacagagacttcctcgacctgtgctgccatccgaggctctttctacccgatctttccttccctatctctatcataggtgacagagctgcctcagggtctgaaggccttccctgactttccaagccttcccttttggctttcataagcatttctccccatttactatcttgtagtgtccaatcatggaggactttaactaggacaacttcagaatggggttcttggatttaggatttttgcctatgaccaaatagtttgcatattcatgcttttaattggtattgtaataatataggtatttgctattttgagaaataattttgtcaggatttgtaggaaatgtcttcctatcatataccatgtccctaaatgagggtttctcaattttggcactgttgaaatttttgactagataattctttgttttggagggccatcttatgcactgtgtgactttcagaagcagccctcaatcctccgccccctagagaccagtagcactgccctcctgtctccagaagttgccaagtggcttctcagaggcaaagtgacccctggttaagaactactgatcatgtatataatttgtgttgttagtgtctgcgtattgtcaatatatagttctattattatattcttacgcctaaggaataaacttttttttactcaacataaactatataatacagttagagaaccactgatcatgtatataatttgtgttgttggtgtcagtgtctgcgtattgtcaatatatagttctattattatattcttatgcctaaggaataaaacattttttactcaacataaactatataatacatttagaaaacatcaaagatggcaaaaaaggaactacattgtatgttgaaatcaaccatgtcctaggaaatacattatatggccattacaattgaaatagaaagttttttaaaagattgcacttgtacagattttgaagaataacaagaatttgtttaaatagaaaaactgtgaggcaggaataattgcatgacctaaatcataaaagcagaaataaaagtacattaagaaaagcgctttccaaggggaccatcttgacaagaagcagaagaaagattcatgctaaaagtggtcaggtagtaaacatgtaatttcttcaattataatattttctaaggcttaaaaggatgtattttctctgcttccttccctttaatctaccaattactaagtcccatgtatggctccacaatgtcacttcagtgaattttcctctccattgtggtgcaggctgttaaacccaagaactttgtacaatcataacatcctcttacctcgagttctcacttccgttactctctatttttatcatttcagtctctttattgatattctctatttttcagagacaacattttcatacttttacttctttagacatggtttctttgatttctttgaatatatttgtaatagattatttaaaatatttttctagtaaatctgaaataggggcttcctgggagatggtttctattgaatgcttttttccttatattaaggccaaactttctagtttctttatgtatcttctaagtatttttgttaaaaatagacatttaatataaagtggccgttctggaaattagattttgtcctttccatagtgtgtctgtttgttgttgttgctgttgtttttgttgagtttctatgcctctgttttgtggtattcataagtgaattctgtaaaatctggatctaattctttttaaattactgacgataattctttttcttaatattggtaatttatgtttctctctgtctctctctctctctctgtctctctctctctctccattgcattgtttgtgctaggaatttagcaagtgcattaatcttttccaaatagcaactttcttaagtgtttttcatatgtatggtctcaggtcttagggcaggccagccagactgggaactgggcccagattaacagtagtgacagtgacagctgtagcagaaacaatggtaggggcagtagttacagccactgcagagagagagagagagagagagagagagagagaaagggctgcatatataagcagtgttgggacccatagtgggaagacagtttgactttccaccccctaagtttaagctatagcaaattttaacactgtggcctgagtgctgggagaggctgtcaggtagcaagctttgttataagttattaaaaaataatagtgtacaagtagacattgcaataatgcataccagcgagttattacaatttgacttcagaatctctagttttgaaaactacaacactgcaaaacatatatctacaagtttagaaatgcaaattaattttaaagatcatcacattcagtggaaaacaataattttcatataagcttcaaacaaacaaattgattaaagagacaattttaaaattaattttttctgtaattgaagatgcagtgatatataaatagatattttgaattatacacatgctataaagccatgtttggtttcttatataacctccatagttacaggagccttcagaggaaacattaaaattttattttataaactaacactttaattaaattcagatttacacaaaattgaactatgtaaagagttaaatatttttagaaatgattgattgattgattgattgattgattgactgagacagggtctctcactcttgttggccaggctggaatgcagtggtgtgatcatggatcactgcagccttgacctctcggcctcaagcaatcctctcaactcagcctcttgagtagctgggactacaggcatatgccaccacacctggctaatagaatttttttaatttattttttggagagctgatgtatcattatattgcccactgtggtcttgaatttgtgggctcaagcagtcctcccaccttggcctcacaaagtgttgggattaaaggtgtgagccactgagatgggtctttagaaacttctaaacgttgaatcattagccctagaggtactaaaatttatgttataaaataatcaaaattgatcttaatatcacactctataaaataatcttatctctagtaacagttgcatcagtggattcttccctaaatgaacaattatcaaaaattatgtactaaaaatgatcttgcattgcccaaaaaggactgatattgctttcagtttaattggaatgaagaagtagaaaagtataaattgtagaaaaatgagaagaaaaatgtgggggtgcacaggaacatattcaagcttatgtacaaggcatttgatgtcgaggcatggaaaaatactgaggcactgtgtgcatgttgtttgtgcatgagactgaaactcctcgaccctgaaaacagggcaaggaacggaatgtgtgataaggagccttgaaaacagcctcctgagaatgtggtctgagtgcttttatatgtagtaaacaaggccataggtgcctcatgatctgaccagaaatcgccagctggtggatgtctcttgtttgtctgaattgtagtttaaacaagctctctcaataaatatttgatggacagatcttggggcaacactctctcagaggagctgctccccaccctgctcatctgaaattgtttgagtacttcattctcagcgttcgctgcagctataagctgcaagtggttaccctgacatgattgccttaaaattatgtgtggagtaagtaaactcatcagtctttggggagtgtcagtaagggacagtcccgacccatttcaggaggatgggaccgattcatataataccaggggttgggttatcctgggtcagaaattgaccaaagagcagaaagtttttttttttaaacggtgcaacaattacttaaggctatccagtgtaccgtaaagtctaaaactttgcataagcttacatttttaatttgacaggaatgcccttgtttctctgatcaagattagactaggagttatgggatcaggtgggtcactgcctgcaaagaagatttgagcagggtcattttactaatgttaccattttgaccacctggactctggtacactctgcgttgtactctctttatatgccagatcatggtgagtcagagcgcccattttcttcacctgaaggtaattcagaaaatttaaaggggaagagaatgcaggaaccagaacaacagggaggggctcctccccccacttcattccattcagtagggcataaagaagacactttttctagtgttgatgaggacagagtgcagccttttcctcccctaatagaaaagccattgccctcttttcctcccctaatagaaaagccattgccctcttttcctccacccttaagaagacctgcatctgttggaccaacagacaactatccggcttacggccaggggagcccctgcagctgcacagaaccagtttcttatgtatctggcggtaattgggaaagcttctgagaaagtaagaaagacatgggtgttggggtggctggtatttcttgttctttgccaggtggactcagctcaagaacatgtttattggagtcatgttctgaatccccctgtttttaatgtgattatgtggtgggatgcagacccgcctttgtcatctaatgatacttcttggacaggaggtagatggatgcccttgtcttaccccttaactgaaatttaggatagattaaactcagtgactctttgactctattgtctagtaatcccctgacttgtttttccacaattactcacaataagtgtattactgtcattcctcaggagtatctttactatcagcccaaaagggatgctaagcttgcaaatttgtcctttatttctgccgttagactagtcttactgaggtctctaatgaagttgtacaagtgccggatcttcctatatgctgtctgagtagagactggccatataagtttgaggccatccagtagtccccgtgcagacaacctgcgccacgtcaggggcctctgtttgataatggcaccttacttgattggggtccccatggtaatctcgtgtctgcaaatcagactattgggtttggcagtccctccaatattgccatcacttggtcagaatatgagctttcaggaccaatgttacaattaaaaaagggaacaagctttaagccctgctcatacctgaatttggagactaggacttccttttttcgaacgaattctttcacatgatgattacactaatagcagtgacaactataccctctgcttgcacaataatgttactgataccgtcctgatttgtactacgcacccctatatacttctgtttgggcaaggtgttcctaacatacagcagaatcaatcttttatagtattaataataattagtaattaataatccttttatagtctcttccagtcgttggtatgctacatgcttgtctcatcgaaatattatacagttaaatataacctatgtcataatcttaaaatggcatacagaattgtggctccctgtaaattttaccaggaactgggaagggattccaccctgcagttatttagaaaagcactgtctcatactcaaaaaaaaaaaaaaaaattctggccactttaattgcctttttagtctcagctattattatattaacaactgccactactacagctatctgtttgacagaatctgttcatacagcctcagtggtgaaccacatgctatgcaatgtaacccatgaatttcaagaacaagtaaacattgataagagtattttgtctcacctagaggcccttgaagcgccgttgaatggctaggagatcaaccacaggcattcattactcatcaaaatttacattgtgattggcaatataattctatctgtgttacacctttgccatatgatagctcccggtatgcttggaagagagtgaaagcatacctacaagggacttatcacgaccacctatcttctcaagtttccactcttgagtgcaagttaaagaaacaacatgaagaatggtcacagtaattataaacaaatacccttcagcaattacaagaagacttttaattgttaaacccaaatacttggttgtctgagtcaaacatacacatttgggtgatggccgctatacttattcttttttatatctgtttgctagacatctacaaatagctctgtgctgccacccaacacatttatgactagggaagaatgatagaagcttaccttgcattagataaccaacatgctctaagaattaagggggagatatgtggggggtgcacagcaatatattcaagcttatgtacaaggcatttgaggttggggcatggaaaaatactgaggcactgtgtgcatgttgtttgtacataagactgaaactccttgaccctgaaaacagggcaaggagcagaatgtgtgataaggagcactgaaaacagcctcaggagaatgtgatctaagtgcttttagattaataagcaagccatatgggccatatgtgcctcatgaccggaccacaaatcgccacctggtggatgtctcttgtttgtttgaattgtagtttaaacaagctctctcaataatatttggtggacggatcttggggtgacactctctcagaggagctgctcccctccccgctcagctggaattgtctgtatacttcattcccggtgttcgctgcagctataaactgcaaaaaatcttatgatcaataaatatatcacattaacaaagtattatgatttattttactataacaacgtgcgactccaaagagactttttaaaataatttataagtttgtattgttattcgtatatcactattgccctatttcattttataagaaaatatttttaaaagtaaaagatttatattttagtacctttaatagcacgtcttggtttctgaaaaagaagtcctgtgaattatgaggttgactctgatgatagtttgtacatagtttggaagtttatagctttaataatcttgtacaccatttatgtgacttttcatgatgtctcttgactttgttctgagggtattttaggggaagggtgaataaggtttaaattaccgaaatattgagaatatatacatgtatctttaaaatattccattatttaaatactaacaatttttgtgacaaatactttttagactgctttaatacttttccctaagaagagttttcaagaacaaactttgataatcggggaatggttttatctccaatcgcctactaattattttcatgagtaagtttgagtcaccttctttatttacaacaaacctcatctcactctcctgttacccaagctttgcccaaagagaaacctgtttgttactattcaaatttaatcatgtcagtaactccatcatttttgccttctgaaacaattttccaaatgacccacccatctccattcctgttgtgatactcaggccctcacacattctctcctgcagttgcattgtatctggcctctttgtcttgacactgtgctgggctgctctttaaaaatacaagaaatattatataacttccctatttagaattccttagtctttaggttaaagtagaaattcatcaacgtggcataaacactttctcttcctcactgctctcttctcctgccttcttatcagcaacctgcatacacattctgtcatgcaaaaattgtttccatttccctgaaagtggcctattatgttaatatcattgtgcctttttatacactttgatctctgccaagaatctctacttgtccattgtcctttcggtaaatgtactccttaaggctcaaagtaaatattacttcctctgagactttatccatggccttccaaagaaattaaactctccaggttttgagccacacaaacaccccttttccatccctacagcagcacatatgcactgtcaatttattgttgattcagccatatgtctttctatccatgctagatagtcatttttttacaggtagagactgtcttttctatatccatttataagcatccaacacagagcttgacgtgtactgtactagacataaaagttatggtataaaagaataaatgaataaaacattagaaactaaattaagaaaactaaattacattccaataacaagtataattagtaccaactttaaaatttgattgaatttttctgtattttggtattctcaaattcactttattttcaatttaaactcactcaacggagaggaattttaattcgtagaattgtaagtaaactcacctaggcttagagaagcaggccaagtgcacctctttgttctcatccatagggctacttcacagggcatctttgaaggaagaaccatgaataaaagtgattgtaagaaatgctaaagatacaaagcattataaaaatatttaacaggtttaatgtgactttctcattacaaataatcatgtctcctaatagtatttaaattctcacttttaagtgcaacctcttttcattaaaatatgaaagctagtaatttccaaaggtgaaaatacatgtcttttctattatagaaagctaaagaggtcggtaattgatgagactatcaaaataacttttattccatattactttgtaatgtggatatgctcacatgtgagtgaatgatatccacttcagggtaaaagtcatgggatagtggttctattgtcaatattatctttcaaaaaatgagagaaaggaccaatcttccttatagaagatttaaaataatcttttagatactcctccccctccaggaggtacagtttaacgcaccctctagagtataaactgtatttaatgactcacttccaaataagggagtatggaaagaggaaataataactttatagtggaatatcctggcaaatattacctctaccagatgattaaggttaagatcactagtagtgtcatgttaatctaatatactctgtatatggtgatgagaagaccactccatctctggggtacctgttcacaaaaccagtaaccacaggttaatcatgagaaaacattagacaaacccaaattgaggaaaactctatgaaatatgtgaccagtactcctcaaaacatgtcgaggtcatgaaaaacaaggaaagtctgagaaactgtcacagtttttagattatcctaaagaaatatgacaacaaaatgcattgggggattctggattagatcctggaacagaaaaaggacatcagtggaaaaactggtgaaatccaaataaaatctggaattcagttaatagtaatataccagtgttggtttcttagttttgccaatttcttagttttgctaaaatgttaactttaggaaaaacggtgtgagggctatatgggaactctgtatacaatcttggcaacttttctgtaattattccaaaataaatgtttaaatacaaaatatcagggcaaatgcaacaattaaaaattccaagagaatatagtcttcaattaattaaaaggttgattaaacctggtatccaaacaaatggaagaacattccatgctcatgggtaggaagaatcaatatcataaaaatggccatactgcccaaggtaatttatagattcaatgccatccccatcaagctaccaatgactttcttcacagaattgaaaaaaactactttaaagttcatatggaaccaaaaaagagcctgcattgccaagtcaatcctaagccaaaagaacaaagctggaggcatcatgctgcctgacttcaaactatactagaaggctacagtaaccaaaacagcatggtactggtaccaaaacagagatatagaccaatggaacagaacagagccctcagaaataatgccacatatctacaactatctgatctttgacaaacctgagaaaaacaagcaatggggaaaggattccctatttaataaatggtgctgggaaaactggctggccatatgtagaaagctgaaactggatcccttccttacaccttgtacaaaaattaattcaagatggattaaagacttaaattttagacctaaaaccataaaaaccctagaagaaaacctaggcaataccattcaggaaataggcatgggcaaggacttcatttctaaaacacaaaaagcaagggcaacaaaagccaaaattgacaaatgggatataaataaactaaagagcttctgcacagcaaaagaaagtatcatcagagtgaacaagcaacctacaaaatgggaaaaaaatttttgcaatctactcatctgactaagggctaatatccagaatccacaatgaactcaaacaaatttacaagaaaaaaacaaacaaccccatcaaaaagtgggcgaaggacatgaacagacatttctcagaagaagacatttatgcagccaaaagacacatgaaaaaatgttcatcatcactggccatcagagaaatgcaaatcaaaaccacaatgagataccatctcacaccagttagagtggcgattattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaaacatgctgctataaagacacatgcacatgtgtgcttattgtggcactactcacaacagcaaagacttggaaccaagccaaatgtccaaaaaatgatagactggattaagaaaatgtggcacatatacaccatggaatactatgcagccataaaaaaggatgagttcatgtcctttgtagggacatggatgaagctggaaaccatcattctcagcaaactatcacaaggaccaaaaccaaacaccgcatgttctcactcataggtgggaattgaacaatgagaacacatggacacaggaatgggaacatcacacactggggcctgttgtggggtggggggaggggggaaggatagcattaggagatatacctaatgttaaatgatgagttaataggtgcagcacaccaacatggcacatgtatacatatgtaacaaacctgcacattgtgcacatgtaccctaaaacttaacgtataataaaaaataaaaaaataaaaataaaaaataataaaaaaacctggtatcataaaaattgatacaagcacatgataatctacttattttaagtgaaaacaaataaatctgttatttcatcttttaatataatggtaaagctttctcttgaagtttattgccaccacccgatttggtacatcagtcagtatgtatctcaggagaaatgtagggtttgattttaatccaacaagtcaatgacatgaaggtcaaaaaagagatctccttctagactgtcattagcagaacagttttgcattgaaaacatttacatgcaggtatccaacatggtatgaaaaatcataaaaggcctgtagattcattttgggttccttaaaaatcagggcatctctagaaggaaataacataagaaccacgaaattgctatatggcatcagaagactgtcagtctagtctgtattaagtgtctaaccactggtctatatttgaagtgatgttattgggaagaacgtggtaagtgctaattaaaagttagcaatatgcgcaaagcccacttaatgttcaagtacattgctatgattcattacttggatccaaaactttttaaaaagtcaagactcctgtaattctttatgaacagctggaatatcacacagaataggcaaaaggggctttcttgataattttcctaagtgcctttcagacattgatttatcaccatagcatagaattggacagacctctatttactaacacaacttagagtattgtcctggagttaataagtatgtgttcacatcactttcctccactcagtccccatgtgacctggtgataatttgcctctaaaatgaaatgataatatttccaagaaggatatattaaaatgtactaagaaggatatattaaaatgaagtaactgaaaagaaaatctgaaaccagaatgcgtagtattagactacaaaaaagaggggaatattttttcttaattatcagatattcttcaaagaaacattgctatccattggccttatccaaaaattgatgggatacctaagaaaaacatgtaaatttgatgtctcaggtcaaggtgaatattctcagtggacgataaatttattttcaattgctatacatttcagttttaagacataagaaaacccagtactggtaaatgaggtttgatgttacattctaaggacctcaactatttattattgagctgccttgtaaagataacaaaagtcaataacgcattgctaagtatctcatctattagggccataaaataattgtatgtgttcgtaaatgttaatgagaaagaataggtaaacaaatgtcactgactataaattagagtttagaaagccaataataagtagtatagcattttaaattataagattccttaatctttatccactgaatgaaccttgatgtagtagcagatttcttcaataagggagaggagccagggctcttgatggcagtggtacacttctaacattgatggtaatatcattgaataattatattagaaagtagcagtttgtattgtaaacctcaatgaacagaaccataatgccacaaaagacagccattaattaagtatgaattactgtattttaaagcactggcagtggaaagggaaatgccacctttgaatgaatggcttcctctgtctgatctgacctcctcccatttagagatgtgaaggtgataaatcactgagtgcagcaacagcagggatccttattaatagcaacctcccagtctcttggcaatcactgcaagtgcaagtgacatgcacaaaggttttccttcttagctgaaaggacgtgaattttttatgagaatttcttagaaatggatatagcatttctgagtcatgcatctgagcacttcatcaattagacaacataaaggttcttggaacatgctatttcaccacatccagctgttatcataatgatttagattgaggattttacatctagtagctatattcttaaaacaacaaaaaatcactttattgtcaagttattgtcctctaaatggaaagaaaattgaggcaataggcaaagggcgtattttttgttgttgttgtttgtttttactaattgaatacttgaaaggggaattaaattttaaatgactagacaaaacctgaatttaatgattttcctttctctcaccctaattgtcacaatcaaagactgttgaatatgatcatatatttttccatttatatctgttcttatactgcctctgaatatgacaacttccactgaaaatcacaaccagatgataagcaagaagtagtaagattcagctttgattttacaacacttctttagaattcctaaaatgaaaagttaaagactttgcttcaaggaataaaaggagtgtgaatttaggaagcctttgtttcagtcctaaattaagccttgtgtaaccttggacaagtcaattatccttgaggatcagtacccacatctatataataaaagtgaccatgtcagcactacctaatgtgaggatgttttgtgaggaccatatgaaacagtgtatatacatgagctttggaagcagttaaatggtatacaaacttaaggtagttttataaatactattgcctatgaaagagcaaaattatggatacaaatagtttgtggataatatgggaatttattaactatattctttgtttaggtcatcaacatagttattcaaaaattgacttatcttactttatacttttcccctcctaaagttttaaccttataatttaaaaatatttattacttctgatttctttcaaccaaggagtgctcacagttataaatctaatgaaaacaatgcttaagtttcacttgtctaatattccctgatatttcatctattataaaaataatgcaacattagagaatttgactaaaaaaccactcgtgagtttatttccaacacttattttttcagtgcatatatagcatatatattcccacaaaattaaccataaattatgtcttaatacttgaccaatggaagaaagggcagagtgcaggaaggataatgaataaatatgcacttggaatttggcatggcatgaatcttttagattaagagaaatgttttcccctttggatctcttaaacggagtaaatttcctgccagaggttattgaaaacagttttttcctgagtcaaaaccacaaagcaaagtactctaatatagtgaaaacattttttaccttcgggaggaaaagctatgacatgtttaaacacctggcagagtacctaggatacaatgtgtaattattagtgtattagtgtaattattaagagttcccccttacacttttccagtttggacaattaattatatcatcgattaacaggtacctagcaaaatattggcattctcttcagtgtctcagtttgaaaaataatttatatgatcaccatttaatacataaaagaccttttcttctaccgaggtgtatttttcacataaacagcgttatgtaattcacatgttcagtaattcagcaaatactgcaaatatttatgtagtgcttactatgttccaggactaatatgctatggaacaagacaagtaaatttccagaagtgatgtagtttgtgttctagggagagaagcagatgctgaaggaaacaaatgcacacacaatatactttctggtactgacatattatagcataatctaaagacaggtaatggaaaataaaatgtttgggagaaggtatataaacactgaacagggagagcatttctcaaaaggtgacttttgagaaaagaccagaatgacccaagggaggcatgctaagatttaagtatgttaggtcaggctatatccaggaaggggaacacctgtgtccagctgctgagggggaaaagaagctcagcatgtttgggaaacagcaaaaagaccaccacagctggagaatattaagcaaaaaggagatgtagctgaagaatctggtgtcaaggtagagatccgaattgtgttacagatgtaagggagctattggagattgacacaatcttcatttagcttccacaatgatcactgtgcaatgtagatagaggagtgcagggaggtgtatacaatttctctcatgtacctcgtcagatatgctcagctgtccccgtctctgggatcattgaccactcattttgtcccggccatcatggcttccaaattaatgtgggtatagcccagcattgccttcctcttgcctgtgccttatgactgtcctaggactaccttgaagccactgaggagtgagacgtgtgggatcttactagtgtccctgtaagcataatctggagttgtaggagagttatgtgtccaagttgaatctttgatcattagaagggagccagtgaataaaagtttcttcctccctcatgacagactgtcaggagatggtggagttcttgtggtctcttaaaatgtcaccttagaagaataagcaatccattgttttgataccaagctagcacgttaacacaccctcttattagctcttccaccttctctgcctcacctaccttttcccttattcctgcatccttggcattgcacttctgatacaagagaagcacataagctttggtcctacctctgctttctggggaaagcagggtacgacaggtgtaagaagaaaagtagaaacaccagttaggaagttgaccaggcaagagatgatgatgaggctgggtgctgtggttcatgcctatctataatctcatcactttgggggccagggtgagaggattgcttgagaccaggagttcaagacaagcctgggaacatagtgagaccctctttctataaaaaaaaatacaaatttaaaaaaaaattttaaagaaagagatgatgatgttttagaatgtaatggctgatagtgaatggtactcatctggctatcaataattaatttaaatatattctttctccatttccactttcttcatccctatattacatgcatattttagcctgtaagacagaaatgctctcataaatagttttctttattttagtctattcccactttttaaaatacttataagtgttattccatgcatagaagtgtttaaggaccttcaagttaacactgtcttaaattttaattccattgtctatatttcaaggctcttattcactggccttattaaagctatctaaatttatgtcatgtttcttaaaacattataatttccttgcttcttaaagtatgttcttatccctaggatttcacttttccttatgctattactttctccatagtcaaattatgtatgtctttcaaggtttgttttcttcatgaagagtataacatttgttacttgggccaccgaataaaaataattacactaatgaggccaacactgatctacatgcttcacatttatgattcctctaaacgtcactatgatgcatccattagtattgtattagtttcccatgctgctgtaacaaattaacatgaatttagtggcttaaaagaacccaaatgtggtatcttacagctttggaggtcagaagtctgaagtgggtctcactgtgtaacaatcaaggtaatggcaggactttggttactcttaaagctctggaggaaaagacattttcttaccttttctagcatccagaggccacctacataccttgtttagtggccttttcttccatcttcaaggccagtggcatagcatcttcaaatctccctgtctgacctcttctgccccttccagtttaaatgaactttgtgatcacagatcatagggattgcggggaggagacattattctgcctaccacaagtttcaccagtttagagcgaggactctgaggcacaaagaatttaagaaacttaactttaagctagtaagtggagaattccaaaacttaacatggttaacaactacatcatactgccacttcaaaagaagagtaaagtattgctagcactatcttacctatattcttttgattcatattgggttaaccagtgtttgctgagatgctattgtgttacatatatcgtaaaataatactctaagaactattatgaataaaagttgagcctccaaaatcagaaaacactgaaatctgaaacgcttgaagaaacaaaacttattgagcaccaacattatgctcaaaggaaatactgactggagcattttagattttggattttcagatttgggatgctcaatcaatatagtgccaatattccaaaatccaaaatctgaaacacttcttatcccaagcattttgtataagggatgctcagtctgtgtaatgattaagtgaacatagatctagcactcaataaacttagattccaacagaaaagataaaccatatcaaattaaactattagatagatagatatagatatataaataccataaatgaaatacattaagtgatgtaagcatctagaataatgagagagtcatgcagtttaccattttcccaactccactgaggttccttgatgagtcatggcttatatttatttgttcatttatgactaaatagtgatactcactgatcatactggctgccctaattagtacaatatttttgaaaattatcattttctactctatagaacttgaattgtttggagtcaccctctgctcttagatctgtgggtatcttttgaaatatctttcatttttaaacttgttttaatttatacatagaaaatgatgaaactataatatatagccccaaaatttctagaacttgctcattggagaatatgacaaatatgacacaaagttatggcctatgaaagtttggatccctgtccttagtttatgacttgtttgctactgtttcaggtttccctgagcacctgaacataaaatggcacctttgcacagagtttctgtaaaatatctactgattccaggaactgcgtgagtgtagtaaatttagttctaggacggggcacaggcatggcatcagaatggtcttgcatagtcctctgtcttcttccttactccatccattctgcctggtgacctttcacacatcaagcctggctaagagcctcaccgtgccctatgctgatgttaagcccaaaagaagtgtcaccagtttcatccctcaccaccaccacacataaaacagcttctgtcttcagaagcagccagttctctcagtctgatctgaccttcccagtcctcttgtattcaggtgtataaaatgttctcctccttatgtcagcaaaatgaaataaatactaaagtgctgtattcatttgttctcatgctgctaataatgacatacccaagactgagtaatttataagggaaaggagtttaattgactcacagtttcacatggttggggaggcctcaggaaacttacaatcatggcagaagggaaagcaaacatgtccttcttcacgtggcagcagaagagagaagaatgagagcccagagaaggaggaagtcttttataaaaaatcatatctcgtgagaatttactcattttcacaagaataggatgggggaaactgcccccatgattcaattatctcccaccagatccttcctatgacaggtggggattgtgggaactgcaatttaagatgagatttgggtggggccatggtcaaaccatatcaagtactttcaaagagtcagtttttcactttctttgaaagccagaatgtgtttttcttcatcatttgggacttctaagttttccacttatatacaggaggatacaagggtatgcttagccctttattttacatttcaacataaatgatggttttccttatgatttgggtacagaaaagataaaaacattattcagaactttcttattatagccttacaatagctttaaatagtcctataaataaaagcctaattgagttctatatttaacatgtttacctgtcttgaaaatattatttattttacacacacacacacacacacacacacacacagagtctgctgtgtcacccaggctggagtgcagtggcaccaccatggctcactgtagcctcaaactcctgatctcaagtgatccacctgcctcagcctcctgagtagctgggactaccatgtgtgagtcaccatgcctggccatcaaatatattaaatattactaaatagaaaatatttgctcttactcctatcatgtggacctagtttatttttatagctaattattatttttcgaaatatcatagatacttctataaatttagccaaataagctttattttctctctctacatatgcatctttagaaaaatattcacttaatatctataaacactgtattttgtggttctttgccttgatattaatatgaaaatctagtatacattaggaatattagaaatgcattgttgaacttttagaactatgtaagtatttaatatgtgggtatctaaaacaacatatttaaatatgtttaatataacactagaagtaaatacactgccatttaagtacagtacatccagtagtattgatttcatttttctggtcatatatttttcacataatgaagaatattttcatgtgtatgtcaattttccatgtctactaagtatgtcaatttatattataataaagcattcctcataatgttttcccataaatcaaacttgccattatctacccaattatgaatgctaacaattttagcattatattagactgtttcaacttttgtttcttacacatttagatgaaacagaaagtagttttgaggctctagttcataaaacttgtgcttgagaggataccacaagttgtgtatattttatccaaaatatttatcaccagaaatgttttgaatttcagattttttcagattttgaaatacatatacataatgagatttcttggggaatagtatcaagtctaaacataaaaattatttatgtttcatatacaccttacacacatagcctgaaggtaattttatgcaagatttcaaataattttgtgcatgaagcaaagtttgtttaagtgcttatgtatggaattttctacttgtggcatcatgttggcactcaaaaagttttctatttcggagcatttcagattttggattttttgtattagggatgctcaacctgtaattatattgttccctcctctctttaatatacgggtaaaatgttatattactataacaccatagaacaccaaaaataccaccaactaatatattcttaagtgccaaataagtgacaaagtgttgtgactatagaagagaagaaaaatcctgcccaggatgatttggtgacactccaagagtactaagaatttgagctggaactatatgtgatataatcaactagaagttagaaggcatttcagaaacggaatttgaacatgtaagaagacttatttgaagaagcagagggttcttacagaaaaatgttacaacttatataggtgggcaagtcccataagtacagtcttcagtaaaaataatataatcaaatctggtcctctaagcaataaattcgttgaccaaaataaaatcctaaaaaatgactataaaatcatctggaaaatgcattgttgaaaaaatgggtttattcaattactttctccctttttctgagctttcatacttttcaggaaatatggtgaagcactgtgttatgccttgtatgaaatgaaaagttgaaatccctgaatatggggaaaaaaattttctttaggatgtttacattctgaataagaaaataatgtttatacaaataatagtagcaaaataaggtcattaacaatgttctaagacagaaaacaaaagaatactacaggtgtttgagagagcgagatacgacatgtcaggttggaaaatagcaaagaattaattatggaggtgctaattttattggatagttaaaaattatcaagaaaacgtaaggcagatattttggaggagtgatatggaaaaagattgaccacgtatgtgagacattggttcttatttttctggagtgtagaggatgaaaagcctttaaattaaatagtttgaattgaggttatggacatatttaattttgtaccagtaatttgcactttatttttaaggtaatagagatccaggaaatttttgttccaatgattagaggttgtgcaacgggaataattcacctgcctgtggtgtgtgcatggtttggggcgaggcaaaattttaagttagaggccattaaaagagagcaacaattaagtaatgttttaactacagaaataacactagaaagaaagctattttctcaaaacattttatagttgaatttccttggatttgggggctaattggacatgacatctaatcaacaggaaggggttgaagagatgactcaagggagtctccaagggagagatcctagaaagaggttagaagggaagacaaagaatagagcccctagaaatatgcctttaagaaggtgaaaaggaaaagggtctgtgaagggaaatataacaaaagaaggaaggtaatatagtagccagacataggagtgtagagggagagaaggttgcaatccatagtgtcattaacaatgtataaattttttctaaatatgaactgaaaaatatctttgtatatcaactagatcatgagcagtgttactatgagaagaaaccacactgcttgagatgtttgtgaccttaatttcggccttctatggagctatctattcttaattgttcttattcagatcccacatttttgtcaacattgtggagctctcagcactgatttagtaaaggacccaatgcttcagatcttcacttcctgccttctgtgtagacgctgcctcttgtctaccacagggtgcatttttctacacagtcacagtcattatatcagccagatcaatcccattgccacttttctctacctcaaaacacctaaatggaagatataaaggatcagataaagttatccaaaactcttgaaattccattatttttgaacccatatatcttatcttttttcacacaccttatgcatagatattttctggatttttaacattaaatgtcatttaagaacccccaacatcaacataatgatgtattgaccactgtatataaatcaagatgtaatttctatcaaatgaaaattcatggggataacaacagggctgttactgacataatataaagtggaatagcttacacttacagtccatgagtatgtaagactcattcctgtcattcagttgcttcaataggaaacaccaattcactgattgatttttattacaggacaggacccagcagaggaaagaaatcactgtattgttgaaaacatgagatggggttgacttgttagttggtgactaaataatagaaatatctccagaggctgtcaatatattctcatactagtatgttagttacatttcctggtaacattaccaaatactgcttagatatttatgttccataaactatgtttatgaaaagtttattatggtatatggcagttcaatgctaataagtggtacagggtcatcccaatgcacatatttctttgaaattgcattgtttgaaagcatttttaaaagaatctgtatgaggaatacaggttacaaactttgaaaatgaatcatctaaagaaataagctttcagccatggttcatatgccctaacctctatttgataatcttacaaaggctgctgccacaacccttacatctactttcaaagctgtaaagataattaactctggataagatagagttgaaaacaaatttgctattgtggtggtggtggtggaagtggtggttttataaataattgaaaactcttcactgtatatgtaaatgttttattttgtgttttatacataaactatataataccggcacagtgtaaaatacaattcattctaaaacgtgctggaatattttgaaagtaaaaggacactgatatacaagcttggaagagtaatccctttggggttaagcctatgaataagaattattttcatgtttaacatgatttcactcactttgcactatgcgtccggcagtatgccacatggctgactgaacttggttttcatcattgtattttacatttctgaattgcagttcatctatttacattttaagattaggcattttcatacttgaagtaatgcatggtaaatttttcaaaatctcactccagtaggataaccaaagggtgttgtgtggatcttctattaaaataaaaatacgtgttcatttttcaaaagaacaaacatgtactcatgcatctgatgctcaataaacagcattatctcttttttcagctaatattatatctacacagtaaggaacttttttagagaaacatttttttaaatccttaagtaataagtagcattgttcttaatatatacataaatgtgtgaatattcatttattaattttgctaaaatgcctggaacacatagcaacatgtcataaacactagtgtactaaggattctgatgctaaaataagctggacttggggttctgtaattttgataacaattaaaatcagcagatatacaatgattttaaataacgtttctaaagcagagggatggaatgccatgtctcataattcttcttttatcaacaagatttctctgttcccacaaacacaaattagattcttttgcaaaggctgtgtgagatttagtctataccttgatttcctccatcatttcaactacagtatgtttctgatttataggtgcattgattgctgcctggcttattgcttgcattatttatttagatcaggcaattagaacctattcaaactccacacatgatataaaatacactgcaggataaaacagtaaaaaattgtcttgagatattggaaataagatcaatttttgaactcaagcaattgacgttaacaatctaccataaatatgtaacttctattagtaactctgagacattatggaagtagttaaagcccttaattttatgacttataaataagcatatctattatatttacttgacaaatctcttccaagttaataagaccttattaagaagaatctattttctgtcaacagcatggtaggtacttttgggaatgcacaataatcaggggagttacctacattcaaggaagttgaaacctcatagagaaaaagcttatgattatgaaagttaagaaaataaagagtaaaataatcaatgtctgtaatagggcaacagtaaaatatgacactatatagcataaggaaataagggatttactgtcaaattatcaatatagggaataaatactataggatttaaggaaaggaaataagttcagtatattgaaaagagacaaaattaaatataaactgtcttaaaggaaataaacaatttatatatgcagagaggccaagaaaaaacattttttaaggatgaaatagagcaaactgcaaaataagactatgtatggtatatgttgaggaagctgcagtagagtagctaactgaaattgaaagttgtcatagcggacagaaagagatatgaataaaaaggtcaactgccatcaccttgttgaggacaaattggtgggttacaagataaatctgaggaacaatcagtggattaagtgaatctcaggagacagaaaagaaaatataaaggggatattcaacagaaaatagtgctcaaaaatgggtgactcctagaaggctgccggtgatgaatagagcattgattcaatgataaaagaactgaacatgagttatggctgccaatcagtatacaggtggataactatttacttagctaaaatgtttgggtgaagagagtaagatgcagaagaaaacagttcgtattcatattttcaaccaaagataaagcaatgagaaaataaaaacataatgatagtcaaacactaattttagaatatttgtatcacaattaaatttattataatacattacgtaaataacgctttaactgtattttaaaacatgaacttttataagacaataatataaatataaattaaaaagaaaaaaggaagattgtgaagttcagagtgcattcagtattccccaggaactccatttatttttctttgctttatagaagagaaatacaaaaatgtaaattacaagaatattactcgattttgttaatcattaatttaaatatcaattatgatttctaaaaatatgcttcatttttaaattttaattctgattaaacattttgtaatacaatatttcaaagttctggttctgagttcagttaaattttggtgcaagctgtcttgtgtgcaaaataatttcacaacaaaacaggtaaatctaaatggaaaaagtttctcattctccattcttgttaaatcgttacagtcatttcagattcactcaccaattgtagaaagtgatgttgttgatgttgaaaatttcagcatttcctaagctagttatgttttatctttgctaaggtcaatcagttatttggcaaaaggactggaagacttttttttctgaactttaagcaaatgcatctaaaacctactaaactttatctaaaatatttttaaacaagtgaaaaaattttgtttccaaacataagtgtacatggtatccatgggtacttcagttgcttaaaaatattgccttggaaaaacagattaactgtgtttccagtatttccgtatcacctgctaagtaacattctattagaaggccatgaatggatttctttccttataaaaggcaacagttcaatctttagatctttaaatctgctacctttaaatctgcttcttttaagttatttacatgagaaaaccaacaaaacaacctgtagtataaatgatgcttgtgttcactgccactattattacagagtataattaagaatttagtatagatcgtgttttttgtttgcttgcttgtttatttttaaatatttctaaaatagcctgtagcagttggggcctttcttgcttcagtttctctcctgcatttattgtccaggaatacaatgagtgaatgttatttgcggtgctgtgtatcggtaaccttactccagaatctacttcatcagtggctacactaacagtaattttttcaccacaaaacaccacttttgttaagtgtcatacacgattaaggacataacttcctccacacatctttttactagctcaaatgatgtttttcataagctaaaacaatataaatgtttgtttttgcatcccacaatgaacaaccttcccaaattatataatttgatatgctggttcttctgtctcttcagcaacgttgtctgtgtaacttcctccacataaagtttactcacaaatctatttaagtttttatgatagtgttgtctagatatcatttcagtcattttttttgaccagggcagaagaaatgtttctttaatgatatggtttcatcttttatttatttcatttttaaggtagaaattagaaaatatacttcaaaatattatttactttaggaaatttctgtaaagtgataagtgatggtttattatgctgtttaatattattagaaaagtggaagcaattggtctttactaataaaatttttagttttaaactgtcttgctcactgagaagcctgaaactattagaaaataaacacattacatgttactaatatttagtatacaagttgatactggcagcctctctcagtctacttggtatatataatattttcagggaatattaggatttgatcaatgcaaacctcaaagtacaaaatgcatttatatagtaatagttgatgcaaatcataattcaaataatattctctaatttaattttttatcaatttctcattagctatggctagattgtcattgtcttctaccccataatatggcataaagagagtttttaccaggaaaaaatgaatcagctttgtcagtttcttgttcatttgagtttgcacactttgtgcagccttcaattcatgttttctatatacttttcaagtcatatatttgtttgggaaaaattggcttgtgccactctagattatatactcctgccttctctttatcaatgtataggaaaactccaatacattaaactccagtatatgaaaaggttgagcatggctttgcattggttaatcttgacctgcctacagaatagtatatataccaaatgaactgagtgagatttccactatcaattgttgcactaaaaattaatactgcttaatgtagttcttattttctagataaaaatatatgagcaaaaattgatgtgcacatgaaacagctggaaaacattttgcagattctgatgcaacaggcctaggttaaaacttgagagcttgcattttacaagctaccagatgattctgagactgctggtcccttgaccatacttggagtaacaagttcttacaacacttcagaacttcttacaaacaccttaggaagcttgctttcagtttgaagacagctgtagacatggagtgtcatttaaaagttttctaaaagacaaaataaacatcaagtttattttaaggaccaaagaatgagataccgataactaagctcttacagtaatgaggtaaagagggttagactgttaatggaaataaaaagcaatgggtgtatcctcagagaaatattaatcttattatgaataaacaattcgtattgatacgggaatacctataattattgttttgagatgtttctctgtcatttatttaaaatattagaaatatcaaatgtacttttaagtatattttcttgaacaattttatgtttttcactttcttgaaacaggaaactcttatatagtatttcacatctactcattgtccaaagttggtaagagtttttatcaattattttaacattttgggccccaaatgaattttgagaaagagtagtaaatgaatgtctatcttataataagtatttctataggtgatttatttattaacttattccccactggatcattgttttgaactcttccttctcctattatgagtgttatcattttgtgatttcaaactctttgtagggtaaaagggatcaagaagggggattgctgttattagaatgaaaagtaaaatggcctagaaaagaacaagagagcaaacaagaggaggaaaggcatagagatgctgggaaaggaatgaatgagaggtttaagagagtcaaaattgaatacctggtgatactggcaagaatctcaaaggcccaacatttgcaaatatgtatgccctgcctgcttcattcctggtaaaataagaatattcttctccgtgacagcctacattttcactggaaagacaatacttataatgtaaaataatatcagcaccaggggtgtaagattaaatgcaaaagtaatttggatgcctgtgaagtgagcctgggaactcttgctgcctgttcgtggtgcatgtatcacgtcgctcttgtcagagctccagcagccttgcctagagctgtgtgccaaacctctggttttcattacgagagagactgggccaggacctgaggaattattcttagatgactgaaagggtaatctagaaaacatgagacccactagggatgcggtatttatgttttatgattcccaagtcagtgctattttcttcagactactgaagacgatgtaagtgggaaacagttaatttcagcactactcataccctgctcaggattcacatggtatttgcagataaaacagccaatgtggaaaaaatgtcggcccaaattgcatttctccttgattcaggtattccacgggggagtcacaatccatttagaatatcagcacaatcattgtccacctcaatcaagttaatgcaaaaggggaaagggaaccattagggtgcaaaaaaaatcaattctgggcatctgtctgcatgcagacctcaggccaaaacagactgagtaccaaaaagtgggcaaaagggaaatcccggatttcattgtgcaattttttgatggtgctcatgttagctgactaatgaacctttcattatgaatcagtgtgttttacagctgcacctaatcattgtttctgcgacttaaaatgatgatgtgtggtagaaggtgtagatgaggtgaggcgtgatggattgtcattgtcaaattattaatagaaaggttcattttctattagaaatataaagtaaaatattttattcagagctcccttttcaactctggttccagctgccaaaatcgactgtatcattcagtgctgcataactttgccaaaatgtgtaggatatttggcagtgcatacatcaaactccttttaaatttagcttttatggaaactattttacatcatcttgtttctctataaagcaaaagtaaattattttttaaatagttaaaatgtgataaaactgtttgataacacaatgaaagaacaattcaaattagtgagctttgtttcttgtaatattaattcataagattcattttccaagttattttcaatatatttgtaatagaggcatactgtaaaattttatgttgcaacaatattagttattattatcccaattttatagattaaaaacagatccactgagaataaataattccctttaggagtcccagtaaagaaacactgaatctacagtttggttcagggaaagctagagatctgcacccacatttacacaactgcgtatgtttaaatcaatacaatatatacaagcatctctatttcatggccatgtataaacatggaagataccattaacatcttaacatataccaatataagtctatttaaaatacatgacagtttattttaaaaactaattaaccaaataaagatccatcataaaagttgcaaatcattttctgtttttatatggtcctattgacatttcgctttttcatctggatctacgttaatggcaaattactttatagcgtgagaaagcagtgaatcttagcagattcactaccattcaaagccaaacaagataggtatgtcttttataaccctaacaacaaaaagattccagaaaactatttctgaaaatgtgtggtacgggtcttcaccataggaactgtgatcaaagcataagcaagctcagtcacaatgtaagtttctactaaagacatctcaaatcagagtataaaagtacatcccatttatcctatttcattccatgttaaacaaatggtatcaggcatccctgagaattaaagagtaggatttacttttaattaattgttttggttgttaaaacttcagcattttgttataaaagagcagagaaatgctattaaaactcaaatgtaaatgtatattattttttgaatgaatcttatttagctgtgtttgagtaggattttaacttttacagacaaatgaagagttacgtggatcttctcttctatttctttgctcttaattttgaggcactgcttaagtcttgcatcagagttatccataagaattaaaaaaacgaagaagaagaagaagaagaagaagagatgaggttagttccctggtttgatttgggagaaactcctcagcagcatttacttttgattaccacactcagcctccacagcaggcatttcatccatggctttaagctgttacatctacttatacatatgtttctccttgaatttatgcactgatttgtgtattctggtatatgtaatggtggttttcaaagaaaatggcaatttttcttaaatctaaaaatgactttttccattttaaaatgattttcttaaatgtctgcaataagttcaaaactgtttttttgtcttcccagtatcaaagtatcaaaatttagatacttcgataatacattgtttaggtaaaatacattttgtaggtgtgggggtatgtgtgcgtgtatatacacacagatattcacatattattttcttttcattaaatttttgcctaggtcttgatccacagtaacattctgtatgactgattataagcaataaaatcagtacagagctctctgctgtcaatactgcagagtcagaacaaaggggaattacttagaagtgtttaataaagggatatgtctaacattgatgcaacatatgccaaaatggagctaccctggcttggctgcaggaagactttgcactacattgaatcctatactagaaattgatatagtttagctccagaactatattcaatctaactttctgactcatgtcacatctcattaagtagcagctacattcttttatgtacttaggcaaaaaatattgatgacattcttgatctctcttactccaatatcccacatatattcttttaacatatcataagagctcaatttttgaaatgtatccccaatcacacaactaatcaccatcttcactcctattatttttatttaagttcttgcctgcgttgttgcaattgccttttaacggacttccttgattccatccttactgcttttgggtctattctcaattcagcatctagagtgcatgaaaccatccagtagcttcccacttcattcagagtaagatccaacatccttccaatgtctgttaatgtctatatggtctggcccagttacttactatctgaatttattttctaccaatcttcttgctcattctgctttggccctactgaccctgttatgatagaaacacaatacttacggttgtttttcagaacctttgaacttgctatttcctctattgaaatgctcttccctgatgtagataagtggctagcctcctgatctcctaaatatattcaagcaaaggagaaccaactggacatagctccaagtaaaattgcaaaaacaatcaactaaccaacaaatacataatatgaacattttgaatttgcctggtatatctgcttgtttttcttagtacttattactatttaacatactatttaatttatttatgcatccagtttatttttttattttttttattatactttaagttttagggtacatgtgcacagtgtgcaggtttgttacatatgtatacatgtgccatatttgtgtgctgcactcattaactcgtcatttaacattaggtataccacctaatgctatccctcccccctccccctaccccacaacaggccccagtgtgtgatgttccccttcctgtgtcaatgtgttctcattgttcaattcccacctatgattgaggacatgcggtgtttggtttttgtccttgcgatagtttgctgagaatgatggtttccagcttcatccatgtccctacaaagggcatgaactcatcattttttatggctgcatagtattccatggtgtatatgtgccacatttcttaatccagtctgtcattgttggacatttggattggttccatgtctttgctactgtgaatagtgccgcaataaacatacgtgtgcatgtgtctttatagcagcatgatttataatcctttgggtatatacccagtaatgggatggctgggtcaaatggtatttctagttctagatccctgaggaatcgccacactgacttccacaatggttgaattagtttacagtcccaccagcagtgtaaaagtgttcctatttctccacatcctctccagcacgtgttgtttcctgactttttaatgatcgccattctaactggtgtgagatggtatctcattgtggttttgatttgcatttctctgatggccagtgatgatgagcattttttcatgtgtcttttggctgcataaatgtcttctcttgagaagtttctgttcatatccttcgcccacttgttgagcttagaggctagggtttttacaaataatttggtgggcaggaggctagggaatggatgctgctgatcagttgtggataaaatcacagtggtttggaaaatggtcttcatgtgctaagtcagcctctgggtgggggccacaggaccagttgagtcatgagtcatgtgttcaggcagagtcacttggttgccagaatgcaaaagtctaagaaacatctcaaaagaccaattttatgttccacaatactgatgttatccataggagcaattggaaaagtaacaaatcgtgtgacatctggcacagtaaatgattatagaaaggcaaactgcacctacatcttagcagtattcacccccttcccataatcctaatcttgtagactttcattagtcttacaaaggggacttcagttcctgagcaaggaggggcttaattttagagagggaccgttttcattcttgctttaaagttaacctataaactaaattcctcctatggttagctaggcctatgcccaggtattaacaaggacagccagactgtgaggctagaaacaacatggtgtcagccatgctagagtcctcttgttattataattttgcaaaggtggtttcacaatgagtgaaaagttgagtagaaactaaccagaccaagaggatgagaatgttttgaagcaagggaaagagcgtattaaaggaattgggaaggggtgcataaaatataagaagagttcaatatatttggaacatagagagcaagaggaagattccaaatgaagttgtagagatataagtggggctggattttggaaggcctggaatactatatgaattttagatcttacctaaaatcattgggaaatcattgcagtgtttaaaatacaaatgtaaaaatcagttttccagttttgaaatatcactatggcaacaattaaagagaggcaaggatgaatgaattaaaggggagaaatactaggtgtaagaaagagttagcagcttctatcagtagtaatccagatgagaggcatcagtggctgctttaggttagtgtattagtccgttctcacattgctataaagaactacctgagactaggtaacttatgaagaaaagaggttttattgactcacagttccgtaggctgtataggaaacatggttggggaggcctcaggaaacttacagtcatggcagaaggcaaaggggcagcaggcatgtcttacatggctagagaaggaggaaagagaccaaaagtggagatgctacacacctttaaacagctagatttcatgagaactcactcactgtcataagattagcaaggggaaaatatgttcccatgatccaatcaccttccaccagccacctcctccaacattggggattacaatttgacaggaaatttgagtggagacacaaattaaaaccatatcaggtagtgtagtgggaatgcagggccatgacccaattcaggattccttaggactagattactaggataaaataagtttaattttgtgcttgtcaattacaagtagaaagtggagttttctaacagtttaatatattaatcaaatcaaattagagattaaatcagaaacctgagaggcatatgtgtaattaataaacaaatgcaccgtaatcaaaggcacaagattatatgaaatcactcaagtggagagtatacagagcaaaaatagaagaggactaaacagagccctaaagaataccatcagttaaggggtgggtagagtagaaggaaccagcaaagggcagagagaaggagcagtccgagtggtaaaagtcaaaactatgaaaatctgaaacacaagggaaaatgatgtttagaggagagacagttgtgaagatgtctaacactgctgaacattcaagcaaataaggcctgagaaggatccactttgcttattaatgtagatgtctatagtagccatggtgcaagcagtttcaggagagtgatggagataagaaccagttgatggtaggttccttatagatagaggaaaaagaaaatgaaaaaagcaactttggaagagttaaactgcaaggaatctgttagggcaaaactgaaacacaacatgcaattagggagagtattgcttgttttgttttgcttcattaagaggagagaatcttcagtatatttaaaggctgatggaaaggagccagtagaaagagattaagcatgggggaatggtgatcatcaataaattcatattcctgagaaaacagagatggaatccagcatactgggggcaagttcattcccatatggaatgtacattgtagaaagtaggtgtgacaatgaaaagttgagagattcccatctgatgggttctatttactttttgtgttgtgagatgaagctagatactgaggataaagttcaggaggtggaatgatttgtggaaatggtttgacagttttctggtagagaatggctgtgtgagctgagtaagaagacaaaataggatttctaggggcagtggtgaaagatctatggacgttcaaaatgtatttatatcgtacccctgtcaatgtgttggaatgtgttcttaaacagcactaagccatgcttatttgcagtcatgccatgcaggtgtgacaaaaggagggctgagcaaggaagtttagttctgagataaaccaatacttatctttgagcatgaaatctaatctcattcaggacagataatacagagttatagttaaggagaaagtagaacggttcatcctttcattcaataaatatttattgagcaactattattttttaggtttatgtatagggttcagggctattttagtagacttaacagatatggcctcttccccattgatctataaggccctgttaatatggaagaactagtgcattggaaatcaccgagtgagatttctagaagaatagagttttgaagttaaagattttattatgtgaaatgtggagtagacctggtttgtggccacagttctaatgactggagtggagttgaggaggagaaaaataactcattgaggggatcactgggcatgatgcagaagcaaaaggaccgagcgatccatgtgttgcatgtggacatggaagtaccttagataatgacaggatatcagtgaaaaaagtaagtaagttttgcaaattgtcaattaatgagagtgagtataattatgaaattgaaaaaatgatcacaaacaaaatccaaatataatgagcttcaaaggagtttatgaaagtgagtagaaaagtaatgacctacagacaatatagaaaatctatcagaacaatgaaggctgatgtctccagatactgagtctcatttagtataggagaaagaagtcacctgagagaactccaagggcgtagggtgggaggaaacagagaccatatgagacagtctagttttagttaaggtgggaagatagaaggaacccagagaagagaataaagaagtagagaaatttgctaatctatgttttaaataggtaatcaaaaggcttaccttttctgggggatgaaaaatgagacacttggccttctgtggacttaagaaaaacacacatgagcgcatacacacacacacacgatattgcttatagagaaaatacatagtcctgctcttcttttttcaatggcagctataaaatttctcaatttgtataaagtaataaatctgtctgatgcttttttttatttcctttttgtttttcataattgtccctatttcaacagtatccataatatgtttaaaacatgttgggaaagaaaaatactgtaataaaattcaaagttctgcatgcccaaactttttgtcttatttggacaaaatcatgaccaaatgtgccactaggactatattgttttgttttttaaaaacatgttttagagctctataagttccactttaaagggactgtggattttataattatgtcttatcaattaataatttggtcagtttcttatactaaaaaaattgtgctcagtagaggaattctatatcaggacctatggattaaagcaatttagtcagagattgatgatttaaaggaaaataatgtagataattatgacaattgtacactgtttaatggtagacactagcttgaatgcactacctgctagttccatggaatgcaacttttaaatgatttgtaaaaactatagaatgtaccagtattcaagctgcaaatattttaatagggcaataatgtggcctgtgacacatctgataatatgtgtcacattatcagatttaacacagaaatgaaataaccatagatcaaactttatgtatatgtatctatgtagacaggttaggcaatttgggtgggggaacaaaatttaaatgtactcaaatttgtttagagcttccctttattaaataaatgtcctcagatcgcatacaaattgtgctgcagaaacaagaggtttttagttctttcataaattttgcatttgctatactatatatcaaataaagttaacttgttctcaagagaggatgcagcatgctctctacaaactggtgtttagggtctggtccagagaaattacatttcctcttatgcaaattacttccataatgattgcatatatatttgtgataatctttgtgcatagagattagttttgagaagggtcattcacttgaatttcaggggatgaaattttgaattttggaaatcgtagactaaacaaagatcctagaatggattatctagaaggtactctgaaagccctttacaaaaaatatcatagaaaccatatccccatgagatatatcttggatcattgatatgaaagtgttagttaaagacatggaagtttagagcagggaaaggaccaaaaaataatacttcatatctacttcttagtttggaaccaagcaagagacaagaatcaaacaggtaggtgtagaagcagttgttttatggatgaagggtagaacaggcaaaatgggctccctcatactttgctgtggaattagacagatatattctcctagtagtggatagaagtctccacagaggcaggccagatgtcacaggacagatcagaatcctccatcttgctgaaaggttggttccaataaagaaaaagaaaaagggcctttctggcactgtgccactccttgtcttaaatttactcctttccccatggaaagcagaaaatggagggtgaggtggtggtaggagtggtgaggagaggtaggaatgcacttataatggaagtcccaccatgtagaaatagaaggatagagaaacaaaatgtgctgtaacaggagcagaggaagttcctcaagaaaaggaaaagcacagatcacttaagggagaatcccagtgcatgtggttattcaaaggacgggctagagtctagcctctgcgaggaggccgtctttcacacacccacctctgcctgagactatcacctttattgctttcatagcgttcctgcaatcagacctttgaatcagtcaagtgtggatctcagtacataaagtcaattagcactatatttgcaaacgatcagtgttaataaaaaatgttagctttctctcttatcacattactacgaaaaagaattagcaaatggaactcttggggaagtgagctgttttcagaaggaagagatttgaggagtttatgataggaataatagaatgtaaggtgagaaaggtggttctatttcataaagggtattcgttaccactcagggtatttttgtgcttttgttttctgggttctgtgtttttgtaattgtcttatgtttgtattacatacgctttttctgtttttcttagtagtagtagtataaaagcaatgtaataagattttttcttcagaaagacaaataggacagccatatacataaggcattggagtaaggaagaaatagaggaacaggaaccagtatagagaatgccataggcaagcagtggtgatatagatgaatggcaataagaagaattgaataacatgaggcatataaagatttaaaaaaacccctactgtatagtctattggattgtctgattatttcactgaagaatttagtgagaaaagttttccagggtcagagctgagttccaagttaccaaagcctagaaccaagaacaataaagtaggaacaataaagtagggaagcaggaatctgtggcttaaaggaatgtggatgtctgccaggaccacagagcagggttgggcaggatgcccatgacattctgtgtgttcccatcattgtccttgaatccctacattgtaatttcctgtttacctattaatctctacttcattattatcacctgctatgtgctcaccagatatgaattagacatggcacctggggactagaacagtcacaggggcattcaagatgggtggagagagttggaggaagaatattccaggcagaaggaatgccatgtgcaaatccttgtgtgtggaagcatgtgacatattgtaagacagcaagaattttagggaaaaaatggaaaaggcaggaggtatggctagaaagaagggtaagtagtattgatgttaacttagtgttctaattgagaggtctgtcaggaatgttcctctctgctctctcactgacatcgttatcaagtcctgatgggttctcctctttctagaatcttagtatttcaatttagatcactctaaggtatatgggtttctcccagatttttatttcgtaccttaatgaaaatgttgctgtctttctatggttgcagaacaaagagaaatttgatttgccttttgatatttacaaactggctttcatgtaataaagcgtccatcatttactgtttttcatccctctggaaagttcagggatgaggattaaggagggaaaatagacccttgtggttttttatttccagtgaaataaggatgggggtctgggcttctgcagaaatattaaatccaaatatctctaattcaaataacgctgtagcttaggtaagcagcaaaagttagacattttttaagcaaaaatagaattccattttaaacaagaatctatacaaaatatataattctcaaatcaaaattctattgctttgagagacagaaagaaggaaagaaaaaatcttaacagcaggttgtgtgtatatgagttatgtttcatatatatctatttctaactagtttaaacacttgttagcagttaattaagttgagtaaaaccatttagaaagagaggcattaaaattatttttaggcattcttcatttttttcctgcatattttagaattgctattgtactatttaatttacaaatactaagttttggagtatccttgtagaatagtcttccatgtataaacttggaatctccatttccaaggagatctttgaatcttcattccctcgcaaatgaaacttcattgtaatgtaataatgtgtttctcagctttcagaggaaaacaatatgatttttctacatggaatttaattggtaaacttcagtataattatccacttctttcacacctagttattctttctgtttgtttgtttcttgaacaatgagtatgttcaattcctgatccaacttttactgacctggaagagttgttattcaacacaaataacccttcgctataaagaaggagagaaccatggaagccacttcgccaaatatgtacagcccagtgtgagagaaaataaatgtttgttctcctgtgccttcttttttatttgattattcctggatttactcagctaaccttgacatgccttttccaatggccacactgaacaatctattgtggtttgcaatcttggaattccttaaatttggtagaaaagagctaaatgggaagagaaacatcaatagagagaataaggagaaagagtattttgtgtatgctgtgttttctggaaaatttagtcaaatgcttctattaactgaaaatattcccatagtttgactataattttggaaaactgctttttttcttagggtactttttaattaagaagatgctttctgtgtttccttaagaaaacaagggtgagaaaggtggctaattctaacactactagctgtgttctaatagatgaagagtcagaatcatttattcacttatgaaatcatgcattattttacactaactcaatcaaaatattattacaagagctcctgagaaatgtctcagtagctcaatctatacaaaatggaaagtaaaaatacgtgtgtcatagggttaaggtaaagattaattgacaaaatacatatgattcataatgactgttgcctggcacagagcacacactttaaaatttaaaacacagagcataaaatttaaaaatacacatgtcatagggttaatgtgaggactgattgataaaatacatataattcactatgaacattgcctagcacatagcacatacttttaaacacttttataattaatttattatactattattttattaacacatttagaggtttaaatgctgcaagattattacatcacttactacaagtgccttgaaaacatcgttttcctgcaaacattttttgactgtgaccttcattaacaaatagttttaaaattgtgacccaatgtacagacacatatttaacttaaattttcaacaaataaaagcattattgtatatgacgcactctgatgttttttcctttctttacctttctattctaatatatttgctgttatttttaaagaactgtctttgattgacctattgcttattatcacctattgcttattatcaccaattgaaaaaagactgtattaccagtattctatttaataaaatataagtcattttaagacttcagcacccactgataggaattgcagtttaagtgacaagagaacatctagctctgtgtgcctgtttatttacagaagtttgccagaagactgagacacaatgggctctacaatccaactgtcatgatcatctggcttctttaataaagattgaggtccactcctttccttaatcctaaacaaaagttaggattccacaggcatcaggtacatatacaattgcttcctgatatacgcaataaagttcggacttttactctgaataggacatttccttgtattctgtgtatacctacttatgcctccatgagtaatctgctgaaagggcaagacgacagtaaatttagttctcattctcagagcatgcatgagcagggagtcttatttatgacagacagattaggagtcaatttatcttttttaactgatagttactaatgtaacatggcatatcctagccaagctaagaaaaccactgggagaagaaaagatcataaacataaaccttgtaaagtgaaattagcttttatttgtctttttaacctatttattcattacttctagtccttatcttttttgaggaatgggagggaaacacaaaatgccacagaagttgagctttgcatctctttatctggctgctaactggtttggcagcaatgtgctatgcagaactgtgctaattaatgagccatggctttggaactatagatcaaggcatcctgtgtttggaagagttgagaaaattatctgtccactcaatcactctttgcatatgcatggtcacatgaagatgcaaaattcatcagagtcatgtagagatgtggtaccatggaagtaaaaaagacggagaaatttgatgcttattcctaggcttagaatgtttaattggaagatacttaagttcatctagaatctagtattattttctgctctgggaatgaattatacccttttctttgacttacattttaagaaaacttgtcagaaaattgatgatttctacatggagaacagaacagtttcattactaaaataacatataataggccacatatgtaatttatcaactgttacttgaaggtgagatttgatgttaggattaagtagaaaacacttctaagtaaataaatgtagaatctaaggttgaggcaacaaatctgagattctgcttacatcaagttcatttgggtcaagcatacctaagatggtcaatagctggcctcatgagaaatgaaacttattactgatattattgatatttggtggaaaatatttaaagtctagtgccaaggttagtgacagtgtttgtcctgtatcaaaatgtcgaccttttccagaggtaaatgttttcagtaaagattaggtgacttctgtgtaatctgtaaactccaaagcaaaatggcagtttctgtgataagagaggaaaagttacatgttcctttccctgccatatgattacatatttattccttcaagcctaaactcaaaccaatggtgaataatctctacctatagtactcgactgtggaatgtaatatgagtgtttattacacaggatcagcccatcacccagaaaagtagggtatagtcagtggacctgtaattttgcatcatgctgtcatcattttctttgggtaaatttatggtttgtactagcccaagtaatcagctggaggataacttggaaacatataccatagacagaagtctagttttttcctattcatatttgcatagtctctttcctgagggcttcttttgaacatttcttttcacttgatgacttcttagctgggaggaaggtttcagctgagtgtttttgtttctttttgttctgtaccacctagaggacgatacccataggctatttctggtgacaaaatggagaaatccaaataggagaaatctgaattaaataagtgatcccctaaaacatgcttgtgaggcttttatttatatggatgcaaagatggtaagtaaccagtccttatctcaactgtgatgtttacagactaactggcctttggccatacttctcttgtgcagcatggttacccatagatgaaactgaagtacaactgaggtgtgtgttttctatgaagttacatacttctgccagttctcactgggaagtaaccagttgaaatttttcccctagagaaaacattgccatgcttagtacctaaattgtaccaagtgttataggttcaccttcatcatctcatgtaatccctataacaattttatctgatagctgatgccagtttcctgatgaggaaattgaggatgttaaatacataaaattgcaagtgtggatttatacataaagaaaaataaatgtaggaatagagaaatttaattcgtcagcagatcaatatcagattaaggttaaaacagcatttcagaaacttaacttgggggataggaatgccatgttaacttgggggcattgacacaacaaataatcggcagagcctagattttaacttgggcctctgtgaccccaagaaaggacatttcctgctctccaacaagctccttcattcctagcacatggaatatataataaaggacaaaacctatgacttgaaatgactctggcacaaaagtatcagttccttgcctgtgtgtttaactaaatgtataaagcacattttcatttctgattaatttatattacttcaactttcccagtactttttagtggtccttggaaaataaaagaagacactatcaggaatatccctaagctatatctacaaaggacataatatgcattttccttctttgctcactcaaaactatttaatagacacattatttaatagatgcaccttaaaatcatttaatgcatatattttgttggctctcttcagaccttttattgtatatattattttatcaaatagggtagcaaatacaattatcatttgaaaagcaagcaggagtaattagatcctggaacttactcaaattcaactctatattatcctcttcttacattttgatgtaagctgctgctgatctaaagtacatgatagtctgtaaataggggcatgtaacaaacagaatgttaaaaattcaaaaatttttttggtttcttggataaaataataaagaacttctcttcctcagagcattttgcaaacttcaatcaatcatgctttcccgagaagtaggtcagcatgcagagtccctctgcattagaactcaagaagtgcttgttaattctgcatgcaagaatccagcaggggatatataccctggcttttatggctactctcaaataattctggcctctacttccttgggactttcaggttacaaattttgcagcatgtttttgcaaaggaagatttatattatctcttgctacattttatttctgagacttagctttgatgagtggattgaacaaaatcagagttattgggaatctaactcaggttgcccaaggggtctgaaacaaatgtgagttacaggaagtacatgtgtttagagaagtcactgagcaatagctctaattttcttttctttttttttttcttgtaaagtgtgtttaatttatccttgatgcactgattctcaacgctttttccctggcccacaagcaccagtaccatttaagaacttgttaaaaatgcagattcttaggcttcaccctatacttactgaaaccactgctttaatgcatataacagaatcctcattttttaaaaaaaaatagcatttattctatcatgtgtgtttccaataaaatcagattgtaaaaatcagtattaaaaattcacaagattcttgagataatgacattaaagaagtaggtagtagccatacatttgatccaaccttttaagagttagcagtcagcaagtctgcatacatgaagttgtgtgcaagcaggaatgcatgtttgcactgatcccatttggaagccagattactttctgcttttgtctcaaatggaaagatagcaggctttaactggcaggaatttctacatttcttgacaaacaaacttgctgtattctctgtggcttcctagtcatgatttaccttctaaatataagtatttatttttctgttgataaagagaccattttctctaattaattttcaagcactggcttcttctaggtgtttcatatgccataatcaaagttaagttaaacgactacatatgtgtctgttaaggccttactgtattttttaaaatagtgtatcaggtattgactgaactatacaccaaaagagacagcagttggagatgggtagagaagggattcctggttccttccattatctccatgagttatggccacagaagcaaacctgattcataagtgattcaactcaccataactcatttaccaggccaaattatgagactggtaagttagaaagcatagcagccctgacactcagtggtgtgtaaatcatgccagtagatttttattatctcaggctgatctgagtatagtagggtatttcttggtataaattcatgtgcttaagagaattaatcacttaagggatatccattgggtacctactagttagaaggcactatggggaatatcaagataaatgttgtattgaatgtatgcagcatgagcagagagctcacaacaaagccagaccctaaatattcagaaaaaactgttaagaaactcgatagccttgtcttgttcatagcttagctcagattatactagtgatttacataagagcaggattatattttattcacttttattttttcagtttccagtgagtcatgtttcaaaataaatcaaggttattcaatgtcttcccttttctaaattttccttataattattttctaaaccactcctgtggcattgaccgtatagtgctataatgtgtattatatttcctatgttgatatgccttatttgcccatgtacagtgtctaaacatttggtagtcacattaaattttactctttacatctaaattctttaaggacttaatattggtctataataactatttgataataattgtgaaaatagcatactagaatttggcatattggatcataatacaagaaatgagacatagcagagcattatcagctgaatggtccaaaacttttgaattaagagaaggcagacacccttgagctagagtgagtggagaaaataatgtcatagcaattcagagctaggatggaatttaaagataatctactcaaaaatttacatgttacagcagagaaaacctaattcctgaaagattaagtgatttattttcaaggtcatacaattttatgttgacttgtactttgttctctcaagttgctaattttctattcattttattagaagttctttgtgcagagatgttgttcttttggcaaatatattaaaaagcaagcaataaataattatgctttctactcattgatggttattttgttttacaaacatatggaaactttctcaaacctttgaaaagcatgaacaaaatccattttatattttttaaaaactaattatatttttaaatacctataattataaagttgttactgatttatgacaagtaattctacatgaattaaaggaataattataaaagtttaacattattaaaatataaaccttctctctacattttatctgcaatacataaaatatttgcttagctagctttaactctaggctttaagctgggtattttgaagattaataacgcatgagtagggagagaagccaggatgctcttcaggttagagaagttgagtgcaaaagactattaagggacaaaattgcaaggaatatttggtttgacatgttagtgttcctcagctgactcattggcatattttgtaaggtttaagaaatggacagcaaagagataagagatgcatattcaaacttttgacagtgtgttaaacaatcaaaaaaaaagaaagtagaaaagatagagatccttgaataaaattgtttgtttgtataagcttctttcactttccagagttattttggctcaagctgaatgaatttcaaaggaatatcacataagcattgaaggatgcagatatggaaacgagagtgtactgcacactgctgaaggctttagaacacattcctttgggtcttgaagctgctggtttggatgtgcattttatgttaattaaaaataaaaataagttttctctcctgtctggggaggatcttagactctctgatggttttgcctgccaggcacacacatccaaggttttgcagagattataatgatagaatgtattgattttagctaacaaatggcaaaacaaaagtcagctggggctccccttaacaataaatgctcagggttttccatgattcctaaatccaacagagttatatatacaggttcagcaagcaaccaacacacttggcatactaggcaggatgccatggtaaacagaagatctgtaaaaaattaatagctccataactgagaggcagcaatcaaaccagaagggcaaaaatatcttgcaaagacgaatactatgattaccttcccactgtgactgctgtgatttacagctacttgggattaaatttaaagaaaagcaatggaaggaataagagatatcactggtattatggctaaagaagagaattcagaggcctacttgaaagtggttgctttgcactcagggagagaaaggaatatctcattttctaaattcaatatgagcccttagtttaatggtgaaatcattttggaaactcattcctttttatatttaagccagttgaatattttgtggaaaaagttttctctagactactccttagtttacctcttcagttcatgtttttaaaaagaaagaaggaaaaattacatcagtgataatacaaataacaagctgaaaaaccctgaatcagagctgagtggattgtttggtatctgcagagttcagataatgacaagaagatgactaatgactcatttgccgataagtcattcattctttagactctgataaatgtactttaatgattttctgttaagcatgggcttaacctttgaaagtgattagaacacatttcctctattttctattagttcaactggtttgtggatataccatgatttaagaagcaaatgtgttcttgctaggcagttgataatttctaaaaaaaaaaaaaaaaaaaaaaaaagcaccttgttaaaatttttagtcaattttacaaactaagtggtggcaaattatataaagagtaatctagactaacagattataagtatagatgttactaaagaccacaaacacacgtgtcttgccttaatagactagccttgtgaacaaaagtagattgtgtagctgccaaaccataaatgatatttttgaaaatgaacacttatttttctttactttctgagtttcttaagactcatcatgtttttttgccacttgcaaattcaatgtgtatttccttgacatagtcatttgcatgtgaatgaaaatagtacttagttttataaatgtgtagtgtgcactcacagacaagaccacagcacttgggttgacatgggacaatacacatgtgctctagctgtatcaataagagatatgtgtacaaactacaaaatggtgcctttgtagcagcacatattaatgtaagtatgatgtctgacattacaacattgagatattctctacatggaatagcaaactttctggaataaattttcaagtgtaaaattattgtaattctgaaacattttataagaaccagacgaatgtggcttcacagtatattagcaaaagtataatccaaatcatttgtgtagcatagagactataacagaaatgctattatttataattatatgaatttattattgttataacatattatatgctcactgattttattcaaacaacctacattaagggctaactggaagccttctttgtgataggtgttgagacactgaataacatcaatattggaacaatatggaaaatagaatttttgaaacatgaaagattttggcaatctctaatacacctatgagctaatttaccaacattgatttgcaatgggttgtgatactctaaaaacattttcccctgctaaagaatcgtttgcccactaaaccaagttaggtgaagtatagctaaaatatagtacaaattttattgtaacacctaaaaactgctctttggtaaaaataatcctacttccctccacctccaacttgagaactcccctgtccttttgtgtggcaggtgtgaaatgtggtataggctgcaataggctgacagaaaggagagtgaagagcaaatagaagacacagagaaatatgattcctagaatcactctgacacccaatgaaagtggctattactgagtcaacttccagaagtagaagatgcaactaggccttgcttatttaaatgggataatgcatttacatcaaattattgcaatttataataggcatgttttgagttttgtatattatatttccttacctaggtaacttactcttgcttttaagttatttaactgtttctgggactctctttaagcaaatacaattataatgaggctttttattaaatttagtgcattacatcttgaggtttaaaggtcaaattcctgatatttgaaacaatgttctcaaattgttagtttaacaatgacagatactttcaattatatgccataatccaacagcacttttattcttcctctctctatataagtaattgatcacttactaatatcagtgatagtatttggagtatatatttttaaaagacacttagttctgacgtgtcaactgatgattatcatttcaaatatggtgcagccattaaacatggattagatgaagcaaccactgatggtacacttatttttggagacctagtttaaatgatgtatgttaaattatttgattttttatggtgccacatcatacgattctcaaaccaccacacaacttggcaaattatgccctaaaatgtctcagaagctagagaggaatagtttcttaactttttcttgtcacaatccataaatagactgtaagctatgggcagttttgggggagaagaagtaaatctatacattcacatggaattcgtggaccccaggttagcctcaggttacgaacttcactctagtgaataagatgaataagatcaatagaaatattctccaaaggtcccttggcaaaaatgctcctttatgaaacacttctatagctactgcccagcactgaacatattcacacagactccaaagagtctctggctctttcctgcttcttctccttgcccaccagaggaattcaataggagagatactgttttaagatggtattccacctgtatcccttttccccatagggttatgtcacttaaattataccttctacatgactcaggaagaaaacattataattccatcaaagtaagaaatatttcagtatatataccaaagtatattattatctattatgttttaatagtattttaaatctttttcatctccctattcaatatgaaaatgctgatgattttggatttcaggcagccttgtaataggagtaatggtgtactgtgattcattgcttgtagttttgctttaaagtttgattgaaatttcaaataacttgttgtaggtagaaactatctttttcccacttgtattaaagagctctaatgagaactttcgatgctttgttcctttcaattaaatacttactctgtgtatagcattagtataaagattggtgtatgcttcaaagataccactaattaagtgataatctaatgtattctgaaacctattttgttttcaactcaagtctgtgtctgttgccaattataccccaattaattccagtttcagtgtgagaaattctttttccttcttcactgtactagatagaggggatgtctttaactgaagcttctctgatcttctagctttgctcctctttcaaaaatgataagctatatgaagcatgttaatttgctcagtgaatttcaataggttctattgtccatccaagtctatttgatcagcgcattagaaatatataatgggtttatgttaaatcaaaagaaaagagaaggtcaaagtacagtcagacaccacattgtacattttaattttaatattctctcaacaaaaatgtataaaatgccagctacattaagatattgtgccaggcattacactactgtatagcagtagattttgtaaaagtttaagaaatgcaaatatcttaagataaagacaaatattaattccagaagaatagcaatttctgaattgtgattaatgagagaggaaatacaatgacaaagctatgacattggatctatactgactcaagtttgaattctgatgctgccacttattgggtaggatctgaaataaaatctctgatcctcagattcccaaactgcaaagaagaaataataaataacaagcacagtttgtgtgtgtgtgttcattttaggccatttttgatactttgcagatgtgttcctacgtctgttattaggcaaattaagacagtttgggaaaaaaaatattttctagcctcttcaacaccagagtttgaacgctgccaggaagtttgaatggttgtgtgcaacaacacacgtgctggctcactcgagaaggctgaaactgaagcaagagccatttagagaacttgaccttgcctagagaaaatgactagctgagtgtgtattttctcaaagaagagccacttagctttgagcatgttgcctcagagagttgtttaaaagagtttcttcttcagagagtttccagaagactgagcaaagacatgattataagtttctgtcttagaaagctaaaataattataccaagctagtctagcacaagaagcaggaagaagtctgaggaagtaagtgatgtcagtaaccataatattactactaataatcatagttaatatctattgaatacttagcaggagtcaggtagtgttctaaatacatacaatactttgatactcacaaagataggtactcatattatcctcatttaaggatgaaagaactgacacacaaataattatttaatttgctcaggtagaattctaaaatgactccccaagattcccagctctcattcaaccaaacagtaatgtagctgctgctgtgagcggacttttgtagaaacaattaaaactgcaattcaattgacctaagaccttaagattatccagatcggcctgcccagaaacatcatatgagctctttaaagcaagaaacttttctcaggctggtggcagaaaaggatatcagaaatttaaaccatgagaaggatttcaggtgttattcctggcttgacatggaggaaatcactggaaaagaccagagggttaccccctactgacaaacagcaagaatacagaaaccacagtcatgctgtaacaaggaccttgatgctgtcgacaatttgaatgagcttggtcgtggatttttcgccagacctttcagacaactactcaatccaaccagtgctttgatttcaaccctgtgacaccctgagcagagagaacccagccacatcataccagactctggttttagaagtatgaactaataaatgggtgctgttttaacccttttttctggtgatctgttaaacagcaatagaaaactaaatacagtcatacgctttctgagtgcacatgctcctaactgctaagctctatggaagtagaagatagactaagacaccggaaacagacctcacacccatgaaatacactgggactgtggtcagagttgaggcctggcaacaaggtacacccaattgcttgacatgagacatcatctacaggggaaaaagtgtgctcaggcatattcctgtcctaggaaagaggggaggaaagagagttagagaggtagagagactgattgagaagctggattttgtgatagcccatttttcatcacatgaggcaactttagggaaggtttacagtcatttgagaagtagatttaaaaatatataaacatgtcagctagggctttgtaacttaaaatgtggctcaaggatcaacatctacatctcctgggcagttgttagaaatgctaaatgtcagtttctgtcctagaccttataaattagaatctgcattttaacaagaccccaggttatttatttgaacactaaattttgaaaagcactaagctagaaaaaaaacacagtttttgcataacgatcagtttccaagcagaatgtagctaaggcaaaaagatctcagaattttaaatatgtttatttattttctatttttgaatattcttttaataaattatagtgaagtatatggcttagaaaaggtacacaaaaattcaaggatggcacaagtggattgcagaactaagaaggaaaatcatatttacaaagagcttcagtcttcaaatggttttcacatcgttaaagaaagatctacatattggaaatatgtgtgttgtttcaaatgaattgtatataaaatgaattgtatataaaagctctgataatggatttactatatgctgcatagtctgatctgccttggtgtgcaacatccctcataaaacacacacacacacacttgtgttttttacttgtttgaatattgtgcacatcttgaaagatgcatctagagctctaaaaaaattatattacatgttgaaattttaaagcaaatctcagtattttaaatcatgaaaacttatttttaaaagtagtcggaattacaaatagcattttcttttaaactagtatacaaagaaggaggatagtttttgttttcttgtaaaataaaattaataaaattaaatatctcattgctttaaagaggacttcccaaattacctattcaaagatatacatttaaatacagatagttctttaaaattaacaattttttttgccttatgaagctggaattacatggagatgaaatttattattttttattgggctgtggagcggtcatgaatacaggaataacttattagatagataaggcaataagagcaagagcaataaattcccgaactcaacaatcctgacatatgattttaattaagatcaaaacaaattgttacaatttttagacatgattgtgagagatgatttagttcttcatctactttcagaagggactatatgtaaatgaacaaaacatgaaaacactccaactacaattttatccataattttcaatgaagattttacatgtaaagatcctgtcattttgttatatattaagtatttttttcactggagtcaatatatttattaattgttcatatgagttaataatttttgcattagacttgaatatcttttttcttattaagtggatatttttaggagggaaaaatagaattacgtaaatgtcaacaacttttcaaaagttataacctttcaagtatcatatggtgggatgtatttgagatgagtgcccttaactacgttattgtactattattgtagagtaaaagtgtacattatttagttaattttcctccttttatcccctgagttggaagcctgctaggaatttatctaacaagaggtatctatttaacctgatcttcagccataaaagtccacctgcagataaagtcccgtagctttagcatgttgtatgctttgtcgtttttagagagtaattactttatgaaaatagtaaatctttaataattacaaacaatgaaaataaatataactgtatatacaattttaaactaatactattaccaaataactttaaggatattcttcttacacactattctgattctgactctgcttttaagtaagtgaaaagatttcattttagatttcgtccagggtaagacaagacgtactgggacagagaaaccatctatgtgtacactttcagttccttgccctgacatttccatccatgcaaattatagtcgctttatagcacactctacttacatgagattcaataagtcggatatgtgatagctgtcacacttcagttatgtaggtggaaagccgaagatttcaccctggagaagtgctgctattaaatagcaaaattggcatgttctataattgtgtgagtttgaagacaacttaaaaaatgtatatgcaacatttatttatttatttaggacacattttcatcaccataattaactttcagggtaactcgtgctcaattttaaagaatgatttctgcattatgcttgttttacttatgatttatgttatattttgagtgtatagaactaagcatttagttgtcataaaatcagaaaaccccaaacaaactgataagaaaattaataatcaatgctaataaatagctggataccctgaaagatacaaagcttaaattagtactttttactacaaaggcattttctagtaagattttcctagttttatgaaggagaagagataaaaagtgtcatataaattggagcaattctaggacaatagggtcttaaattttactttaaaatacatttatatacttcattttctcttctttgtggccctgggtcatagtttttttaaaaatgaagaaaagacactgcttttcaaagaatgagtctgtagtatttaaattgaagctgaaattccgtgcctcaaggtcaacatctaactaaactgaacatagaagtcacactatcttatttgtatgagggtggttcatttatttccttacaaaaaaagtgctgtatttggactattctggctcttaattagttatcggcctcttggcaatgttaaagtaccttggcattgtgaatgcaaaaaaaaaaaaaaaaatcagtgacatttcaaggcacctacatgcaaatatgcttatattttaaatcatttttataaagaataagaaataaagttatgctacacagctgatccaaaacctgatctgattctccacttctacgtaactatttaaaatgatgagaactgttagtttctataattaacatcgctctcctttcacattaccatttctgaaatcagcaaattccctaatctctgtacttcctttcaatgttggatgatttccaatttgaagtgttgtttttaacctaagtagaatcagcccagaacagctctgtgatactttgaggaataaaggtgtctttggagagagaacttcaagtgcaaattaacttgaaataatttaacctgagtgtggaataatttgcagtctttcttctgtgcagctgtgggaattgcttctgtaggcccagttggggaagttgcctggctacttgcaattttgtcacatctgtcagctgtagctaaatggcaaatatagtaagaggtaacattacatagatttgggacattccctagagggtcttgtctccttgcagcagtgaataaattatatgaaagctgaaatgaaataccgtattgtatttgccaactcatgcaatttgaaagaatgaaaaaaaaaacttcactgcttagattcactatttaaattctccacaaccaacaagctcctatctaccacgatcatattttctgatccaaaaatcagacctgtgttatctgtggcaggttgtattcttttctgatctgtaaatttttatgaaactattttacaaagaaataatcgtatcatatttagatacatacatacattcaacaaattgccattttggaagtaatgaaattgtacagaatcagacatgccagcagatccacaatattaagcgtcagagtctatagaaggctaatataatgattataattatacagtaaaaacagtcaacagcttccagatcaactggggcattcgtatgactaacatatagttgaagaaccaagtatcagtcacttgagcagtttattaaaagacggcaatgtacagtgcctatttaatttaatttgtatttaattggtattgtttttaatggaggaaatttgttcagtttctaggaaggtgcctaaggatggaaactgcgtgacattcagtatggacaggttcttcttattggacaggttcttgcattttctgcacgtagatctttaactaggtaggaggttaataataacacttgcttctctcatcatgaagagtttttctgaggataaatgagaagacatttgaaaacaatttataaactataaaatatcaatgattattattatcttttggagtctaataaacagctcaagaacaagaattctagatgcctcctgcttgggtcttgatataaaatgtttatcaatataatctctcatatttgtcttgatactcattcaagaaatatttactccatattaaatatcatacaaaatactatgtagcacataaaattgtgtatgtaagtcatcagtagcatgaggaagtttttagttgtaaaatatgaaaccacataaaagcatgaaaaattattacagagttaaaaataaataagaattgttttgtgaagacgtctgggcatgagttaagccttacagagttaatgggtagttgacagtctgagtaaagtggagaggttattccaggtatggaaaatgtaatgcaatgaggttttggaggattttaggccaaagacaggttggccaatggcaaataatcaattaaatttaaacatgggaaaacattaagttatatattaaaacaatgagaattataatatttacttggagctcatatgttgaaagaaccataaatcttacattagggaaagtcatcaaaatcgttattaaattcaaggagatagcaatcaatttggcctggccaaattcaaagatattgaatccattgccactatttaaaggtttgatattctccacagaattcctatttccagtcttcttgagcttctaattgaaactataatagtggatccatattctctcatggccataatcagttagaactgaactcatgtttcattatagatatgttctttctatattacattactacttactctattcagtcatttatgctgcatgcctataagtatacgggtttgaaaaccctgccctgtaagatacaggaacaccctggtttgacatccataaattaaaaatttactttcccaggtagccccatcatgttttaaaacatgttttatgtcccttgtaagttgtatttctaggtattttattctctctgtagcaactgtgaatgggagttcactcatgatttggcggggcctgtcggggggagggggataggcgagggagagcattatgacaaatacctaatccatgcagggcttaaaacctagatgatgggttgagaggtgcagcaaaccaccatggcacatgtatacctatgcaacaaacctgcactttctgcacatgtatcccagaacttaaagtaaaataaaacaaacaaacaaaaattttaagagttctttataatgaattagaattgacttccttatatcttccagctatatttttgtcctaaatatgcttaatgaagtcacacaagaagtgtgctatttttttctatagtaaacctttaaaaccacatattatccattggcaattttactctcatttatgggtttaatttccaaccatgttgccaatccattatttcccattgcctgcagaacattcatagagctttgccctacacagtaatcccaatacaatgtgtctattttgtgactagactcaacatcctcctcaccaaaccaggttttactgtgtttcttagcctagaatctcacctcagcattccccaaataactcagtgtagaaatctagaagtcttcctaaactcctcatattatatcacaatctttacacatttagcaaataccaaaactacacttaaactcatttcagtccttcattatcatttaccatgggccactgcaatagcctcctatctccctaggccaccctaagtcacgtccgcttcaatcttttatttatattgcttccagtggttttctctaaaatgtggatttcttcatgttacctcaccaaattgaaaaatgtcattggtttatcaccatattcaagatgaagcccaaactatttagcttgtctttcagaatctgtttccacctacttttcagtatcacttaccacaatgtcctaacctactatctttggaccaattactccgtttagttttccatattatctgtcaataaattactctcccttcatcttttctcatttgacagtttaatttcctcaggtcctataatatgagttcagttcatacttcattggtcaggccattctgtttcaccccaatcaagacagattagatactcaattttgtcttttcacagcaccttattgcataaaactgacactatatggaagtcaatatttgcttgtttttctttctcaatactaagtaggctattgaggatccagattatatcttgataattttttgaagcctaggatctggcatagagagtgatgcatgtttggtgctcattaaatgaaaattggataaatgaatcaataaccagttttaggttaaacactctcaggttttaatacattctagactctcgatatcctaactattcttggtatactatgtttttgccaatactgtcctttagttaaagtgtattatggtcagcaagagatgaacaggagacataattctgtgatgaaagatctatgaaacttaaagtcagatatagctggtttaatatctcatttcattcaaatgttacctatgagattatgagaaatttactcactttactgggtcttggttttctcattgtaaaacatgaagaataatatctggctgcaggattattgctgagattaaatgagacagtctaggtaagaattctgccatgtagcaagttaatattcaattctttacctcaggcttctattctagactcatcacatcattacaatatgaaagagatatgctacgtttatgtggaattgtcttccaaattatattttgaactcctgctctcttgatagacatataaatgaatttatatttgtaggagatggagtataatatgctattacatttaggttaaaaatgttggaataggaagcatattgcatattttaattcaagtatcatggctatattcagaattacattgttcatccaagaggtgaaccagaaacccagctgtcttttctgattgctatgaattgtatttaacaaaccttgtgagcagtgtaatgaacaatccttcaaaattataaaggcttcaccactaccttatattgatttggtgagatcacagtcagctactctctctgcaaggtagcatcacttgtttaagcactttcattggtattctaacctgtgtctgaataatcttggtcatctgtttaagttggaaactctacaatggagatagaatagcacttggattttagtggctgacatgtaacaggaataaaaatgaatggtactatatctgaatcatgttcatttcccataggaagtggtggtcccgcaggcccaactgtggcttctggtggcctgggaaaaacatacagttgggctacttttcacccttgcttctaatgtatggaggcaaacaccaattatttgaaatgacattccaaaggaataacattgtaaaaaagtccaaaatgaaatcactgataaactggagtcaagcttagaagatagccaagagatgcaacaaaatgagactctgggaaacagaaggtaatagcaagtagttaagagtgaccaaactcctttactaccttcattcatacttttatatagctgcacatttttaaatctcaaactgaaaacttttctgactaccgttagaaacctaattattgagttgttgggaaaaatagaccaggaaacaaaatcattcctgtgagttttatgaaataaattgctacaaaaatatttattgaattgtcatggaataagtaaaatagagatatcctaattagttgtaagtatcatatattataaaaccttattaaaatatttatgtaatgataatcatgctctagatcatcggaacagctaccatatgtcatggtacatgcacctgctgcatgccaggtcctgtgcacaaatattttctcatttgttccagcagtgacactatgattattgctaaccttgatttctagatgaggaaaacagagactaaagctagtcagtggcaaaggaagaatcctaacctagaattatctgacacgaagcccactacttttctattatagtaacaaaacatgatggtgtctacttacggttaaccctaactttactattctgactggatacctcaacaactaacctaaaacaaagactagatgttaatctcacctctaccattttctggctgatgaactgagtaagtcagttaaacttcctgagctttattttaaattacaatttgtagacagcgtatgttattactagttttactacattataagaattaatctagttactaatagatgtattctgtgaagtataaaatgatatacttggttttagagtaccttagatgtgtaaatttactagattataatattcacatatattgaagatgacaacatttcacagtaatgtgtatgtcctttgttagaaatgtttcttacatggtaaatttaaatatacatctatataatcaaaatgcaattctactatttttttcctactttaaattctctttaaggtgtttcctgaaaagtttagggacaagtttatattcttgaaaagttcattcatttcattcatttaagtttaagcagaggtcaataactctgaggaatatatttgttatttcaacagtgtattctaaaacaaacaaacaaacaaaaaaaccttatagcatgagataccctttagttgcaagatacaagttagtatccagataagtgacttaaatgaaggcttaagggccatctgtgaagccatagacttgatcatagaatcttctcctgaagaatttcagctatttggcttaaattattgtttaaattataattattatttttagtaaggttttagacatctcacaggaccctttacacaggtcagtgtttatatgtagaattttatattgaaaaattaattccagagtttatagttagcattaggaaatcttgttgtcttttaaactaattcacagcaattatatttaaactaatttgcaaagactacttgaggttacttggtggaagatttaggaagaaaataactgtgaaggtacaagctgaactcgagtcctaacttcttcacaccagagtagctttgttcttatttgttgtgtacaatttgttgtgtacattacgcatctgcctcatattttattttagttctcttttattttttaaaattcggttgttaagaccaaaacaacagtattttaaaatcaccagcctgaaataaagctgtcctatttttcagtgggaaatgatagagaattgctcttgaagtaatgcacccttcctttaactgtagagactgaggtatctattttatttacataaatgattagcttcttatttaatgaatcagaacactgtaaatgcatgcttccataggaagtacgtgaagccattctgttaggactgtaattatgcccaatccaaatacctgaatgttttcaggctgcaaattttgtagacaatatttctactcccaccttctgtattactctcacagattttggttgtcattctggaccacttgtattgagctggaacctttggatccatctcaccctacacaagcagcctctcttacactaacatggtgtttggcttgacacttgtggctttataactcacacagtctttatgattggagtttgttaatatagaatttccttttgtatctctgcttactaacagataggatgtgatttttaaatgttatttttgaattattatttggtatctgaatgttatatattatttcctgagaatggtatttcctataatttatgatatgcctatcatatctcctatgataggagaaacataaatttttctatttcaatatcatttttataccaaaagttttactcatatatggagtttaatagctactaaagttgtcttaataattcaatgtaattaaataatatgactgaataaacatatttactcatccaaaatacagtactaactctgaattttacatagaatattatagatagaaaatcataacattgtagatgttattatgtatagatatagatgttatggattatatatagatattataagatagagaattataatttttgtgtatgactcttgtaaaaggaattatagaatataaaatttggaagaatttccaaggcaagtattacctgattggaaggtagccctcttttttccaagttaacctctactcccactttctattagtttatactcttatttcatcaagaagtctccactaacaccctgaaccaggttaaatatctctattgtactctgttttgatatcatatactactctttgataatacctattacaattgcaacttgcatggtaatacctattaccatgcactttcttatgaacatttgaataatgtccctagttgactgtgagttctagaatgacaagagaatctttttgttcatcattgtatccttagtatcctaacactagacttaccaagttcaagaaataaatggttaataaattttaaaaatgcatgaatgtgagttatttccctcatttggagttaccttaagaccatgttttaaaggatacaaaaacctaacatattatggacattttcattcttatgtaaatcatgttccttactatatttcttccaaaaatatgatgaaaatgtcagctgccttttttaaaaacagtgagcaattgctttaaaattctgtgactataccacctcaacatttttctttgaatttaccattaacacctatgtactttggtgaacattttaacatttagaaaatatcacttcgaagaaaactaaaaattgttgaaggaagcatgatccaaatatcctaccacttgaacacaatcatattattagcataaataaatgtttaattttagtctatataaaaagattcttgtacagaaattgactcagttttctcaaggaggaaattcgagaaagtatgggttgttttgagagtggcataattgcctttatggtgctaatctccccgccaaagggctcaaggtgaattgagatagcttccctggagcaagagtcctccacaaagcaagtctgtctcaagcttacaccttccaaaataccgagacaactttcttcactagaagagctgaggaggaaaacacacacagcagcctcagcacaggtttcaagacaggagataaaataccagagaaccagtggaataaattgtcactaccattcagacttaggtttcaggaaatagagcttgagaaaaagagagataactgagcagactttgtcaaattgagaacctactttatgccttaatcctaatttatacttatattaatgtttgtgttatacttcccctgtaatatcaatctaccatacaaatttaattttgagaaaaacacttcgaaaatacatgactacctgacaccctcttgaaccaaggtgaatatgtcctttgcttctgtatatttaccaagtctggttactttttggatcctgaaaagtcaggtagaaagatatatagtagtctgttacaatagacaaacaatttatcctttaaatcaatggataaaaatatacttagcagaggaatttgaagtgttgttttctccattctaagattgtatggtcatattgagtacttaggttcacatttgctatttaatatgaattctttgttggaagctaaagtttcataatatcctccttgaaataaaatgaaaattataatttggcagccttgtagtaacaactaaagatttgaatttaatgtgggcagatacaaatctctggagcctggcttggcagaaatgctttgtggtctttgtccaaacttgcctttttttttttttttttaactaattccaaatgggtgagaattttcttaattggagtaggcaccatacataaaaagctatattcaccccatttactatggatagctaaagatctgaactcttatattttttgaaatcataggttaactttcttgcctgaaggagaattgcacctgggaatggcatttccattttctaaagaaatatgaccaaagaagtaggacgaaaatggcccctgacattaacctgtggctctcaaggggataacatcatttacttggtttgataaaagaaaaaaacgtgggcttcttttcaattgacaaaaaaggaaaagtgaggagtatggactctttctttcaaacagcttctcaaaacctttcctctgtagaatatgacaaggccaaggtcacagaagtggtttctactctctgtactgtcagttgttcaaagtcaaaattctgttccagtaaaaattacttctctatttcaatcaaattagaggaaatgacagttaagaaaaaagcattttattgcacactgtgatgtctaaggcagtcaatgaaccggcaagtgctttgaccttacataatagttgccattttagcagctttaaccaatttggtcataattgctgggcagatgctttttcaaataaagaattccgtggctcagactctaagacttttatgacttaggtctatcctgtctaaagcttacattgtcattgtcaaatcttaaatattttttctatattgtacagaaattcttatccatattttaatcctaaacaaaggaaaacttgcaaatgtttttttcccatttgagaaaacaaatagggaagagaaacagaaacttttttttctatttttctttgcattctatctgtacgaatcccaatgaagtctatttttattatatacttctttatagcttaaacttttaaattttacttactttactacaaatcccaaatggttactctgtgaattaactgagataatgcaagatgagtgcagagtagtgaacttgatgaaatgcagcccaacaatttccttgtttccttcctcctccattacctctcatttcggatctgcctaactacacctcttgttactctctccttgctccacgcacctgtacacacacttccttctcctattcagaacatttgctcatgttacctctttatctgaaatcttctcttcttgttccctacaaagctgctggctgttcatttcagtctctatttaaatctctctctcagaaaggtcactctgtgtattctgtaagggaagtctcgcttcttttctaagacaacatccttttgttcccccatggcatcatctcattttgaatgtgtggatgaatgattatatgcactcttggtgttctctccattaggctataagcgattgagttttaatccaggctcctctttacaatatctgaggagctttaaaatagtattgattgttgggccccattagctagaaattcccagtaactggtcttgggtgacgcccaggcattagtactgtttagaatgtggcacatatatacaccatggaatactatgcagccataaaaaatgatgagttgatgtcctttgtagggacgtggttgaagcgggaaaccgtcattctcagcaaactatcacaaggacaaaaaaccaccgcatgttctcactcataggtgggaattgaacaatgagaacacatggacacaggaaggggaacatcacacaccgggggcctgttgtggggtgggggaggggggagggatagcatttggagatatacctaatgttaaatgaggagttacagggtgcagcacaccaacatggcacatgtatacatatgtaactaacatgcacattgtgcacatgtaccctaaaacaaagcataataaaataaataaataaataaaattcgccttaaaaaaataaaattaaattaaaaaaaaaagaaacaccccagatgattttaactgacagcagagttgagaagctctcccgctgagctacataatggttctagttggcttcattagccactgtgtgtaatcagtgactggcacatagcctggcctgcatgaccaactataggatatgaatatttgacactggcattctagttttctttgtttgtcaaaatacttcttggagatgacagaagtattctcaagtaacaacactaaaagttgaaatgaaaagagtgctttcaagcctaataactcttctgaatttaataataaaatattatcctgatttcccttcccagtgataaaagcaagatgtttttcttcagtcttctactgagaagaatgttttgatattttaaggttgtctgagctcatattcacagaagccgtgtgtgacaataagccacgtgtgagtgtgtgtgtgtgtcagtttcatttttcttacctatcaggatcaacccatagatgactaatgacataaaccagtatctctatcataggacagtcattctgacttgttacaactaaaatgaatgattttaaattgaacatataaatttcttcttcttagtgattagcgaaatacattttatttatttactattttattttagtgcacatttttatttctcaagactggtgattctgtcatatacaagggccagaaccaaggtgaggcaagtaaggcattcatctcagtgcaaatgtaattggggtcaccaaaaactcagtagtcaaagctataatgtttgatggaatatttttagaaatcaaaattaatgtaaaaaattatgaataaaatatcaaaatttctttctcccacatattatttttttattcattgagaggtatttgggtttgtttattttccccaattttcatgttagattcagagggtacatgtgcaggtttgttacctggatatattgtataatgctgaagttttggttatgaatgatgctgtcaccaaggtactaaacgtggtacccaattgtaacatttccaaccctttcccccatctagtggtcttcagtttttattgttgccatctttatgtctataagtacccaatgtttagctcccacttataaatgagaacatgcagtattttgttttctgttcctgcactgatttgcttaggattatggcctccagctgcattcatgttgctgcaaagaagatgattcactctttttatgactgtgtagtatgccacagtgtgtatataccagattttcttcatgcattccaccattggtggacacctaggttgatttcatgtctttactactgtgaattgtgctgttattaacatgcaagtgcacgtgtcttaaagaccattggcaggttgagccatatgaaagtctgaagcaaaaagtcagatatgtaccctatgtacatgttgttatgtatcttttcatgagcaatcttctccagaacattatagttggtgaaaagaatgctaaatagcattattttatgttaaaatttttaatagctccttttattaaaattttagattcggggtacatgtgtgggtttattacaggggtatattatgtggtgcaggaggtttgggattctattgatcttatcacccaaatagtgaatatagtacctaacagttagtttttcagcccttaacccttactctttctccccacctttgggaatccccagtgtctattgttcccatctttatgtctaaatgtacccaatgtttagctcccacttttataaataagaacatatggtatttgggtttctgtttctgtgttagtttgctaacactgaaaaggacatgattccgcttttatggttgtatagtattccatggtgtatatgtacattttctttatccagtccaccattaatgggcaccaagtttggttccatgtatttgctattgtgaatacttatgtgataaacttgcaataaacaagtgtctttttggaagaacaatttattttcctttgtgtaatactcagtaatgggactgctgggtcaaatggtaattctatttttagttctttgagaaatcttcaaattgctttgcacaggggctaatttaatttacattaccacccacagtgtatgcattcccttttctctataacctcatcaacatcagttattctgactttctaataatagccatcctgactggtatgagatggtatatcattgtggttttgatttgcatctctctgttgattagtgatgatgagctctttttcatatgtttgttggctgcttgtgtatcttcttttaggaagtgtccatttatggcttttgcctactttataatagagttatttatttcctcttgatttgtttaagttccttgcagactctggatattaggcctttgtcagatgcatagtttgcaattattgtcactctttctgtatgttgtctgttttctctgttgacagtttttttgctgtgcaaaagctccttagtttaagtaggtctcaattgtaaatttgtgtttttgctgcatttccttttgaggacttagtcataaattttttacctaggccaaattccagaagagtacttcctagtttttttttgtaggatttttatagtttgaggtcttacatttgagtctttaatccatcttaaattaatttttgtatatgatgagaggtataggtcaagtttcattctgctgcatatagttagccagtttttctagcaacatttattaaatagagtgttctttccccattatttacttttgctgactttgtcaagaatctgttagttggaggtgtgcaaatttatttctgtgtcctctattctgttccaatgatctatgtgtttgcttttctaccagtaccatgcagttttggttacttatagccttgcagtgtaatttgaagttaagtaatgttatgcctccagctttgttcattttctttaggattgctttggttgttttggcttttttatggtttcataggaattttagaatagcttttctaagtctgggaagaatggcattgataatttgataggaattgcttagaatctgtagattgctttgaacagtatagatattttaacaatattgattcttccaatccatgagcatagaatgtttttccatttatgtcatctatttgtttcagccgtgtttggtagtcccccttgtagagatctttcacctgcttggttacatgtatttttagatattttttgtatggactaatgtaaatgggattgcattcttgatttggtttccagcttgaacattattggtgtatagaaatgttactaattttgtacattgattttgtatcctgaaactttactgcagccatttatcaaatctaggagccttacagtggaatctttagggctttctaattatagaatcatattgtctgcaaagagagatgattctacttcctttttttttttctatttcaatgtctttttttttttcatgcctcattgctctggctaggatttctagtacaacattgaatagcagtcatgagaacaaacatccttgtcttgttcgatttcttatgaggaatgcttccaacttttgcctgttcagtatggtatttgctgtgagtttgtcacggatgggacttattattttgagatatatttctttggtgcctggtttgttgaggatttttaacatgaagggaggttgggttttattgaatttattttctgtgtcttttgagattatcatggagtttttttgtttttaactctgtttatgtagtgaatcacatttatcaatttgtgtgtattggatcatccttgcatcccaagaataaacccacttgattgtgctggatattttttgttgttgtgttgccagattcagtttgctaatattttgtagaggatatttgcatctatgttgatcaggaatattggcctgtagttttttgttgttgttgttgttattgtgtctttgctagattttattatcaggatgatatcgatttgtacaatgagttacagaggaattcctcctcctcaattttttggaatcatttcagtaggattgatactggctcttgtttgtacatctggtagaatttgcctatgaattcatctggtacagggcttttttgggttggtagtttttttatcactcattcaatttcgtaactcattattggcctactcagggttcctatttcttccttgttaaattttgggaggctgtttgtatccaggaatttattcatttcttctagattttctagcttgtatgcatagacatgttcatagtagaatctgaggatcttttttgtttctttgggattggttgtaatgtcatttttgtcatttctgattgtatttatttgtatcttctttttctcttttgttaatgtgttaacattctatcgatcttgtttatcttttcagaaaaataacttttcgtttcactgatttttgtatagattttttggtctcaatgttatttagttctgctctgattgtagttatttcttttctgctagctttgggtttagtttgttcttgttttttagttcctttaggtatgacattagattgttaatttgtgattaattatgtttcattgttcacctaaaagtcatttaggagcaagttgtttcgtttccatgtatttgtgtggtttttaagagctcctgatgatattgatttctattcttattccactgtcttccaagaatatgcttggcatgattttgatttttttttttttttttgagatggagtctcactctgtcactcaggctgaagtgcagtagcatgatctcggctcactgcaaattccgtcccctgggttcaagtgattctcctgcctcagcctcctagtagctgggattatggacacctgccaccgtgccaactaatatttgtatttttagtagagatgggatttcactatcttggccaggctggccttcaactcctgacctcatgatccagcagcctcggtgattttttttttatttgttgagacttgctttgtgaccaaacgtgatcaatcatagaatatgttctatgtgcagatgagaaaaatgtatattctgtggttgtgagtggagtattctgtagatgtctattagatcaagttggtcaagtgtcaaatttaagaccaggatatcttggttagttttataccttgatgatatgtctaatgctgtcaataggatgttgaagtcccccagtattactgtgtgaatgtctatgtctattcttaggtttagtggtaatcattttataaaattgaatgtgctaatgttgtgtttctatatacttaagataattaaatccttttatcattatgtaatgtctttctttgttttgttattattgttgtttgtttgctttttattgttgctggtttaagactgttttatctgatacaggaatagtgacctctgctcttttttgttttcagtttccgtggtagatctttctccatccctttactttgagcctatgggcatcattacatttgagatagatctcttaaagatagcagaaggttaactttttaaaaatacaatttgccattctacgtcttctaagtagagcattgaggctgtttacattcatggttaatattgatattaaaggtgttagttttgtcgtggtgttattagccagtttctttgtactcttgattatgtaatttctttataggatctgtgggatatgtacttacatgtacttttgtggcagcaagtatgattcttttgtttccatgtttagaactcccttaagcatctcttatagggttggtctgatggtaacaaactcccttagtgattgcttattgagaaaagactttatttctccatatttatgatgcttactttggtgggttatgaaattctttgttggaatttctttttttaagactgctaaaaataggccctagttgcttctggcttgtaaggtttgtgctgagaagtctgctgttgttctgatgtgatgccctttataggtaatatgaaccctttctctagctgcctttcaggttttttttttcatttgaaattggaaattctgctcactatgtgtcttggagatggttgtcttgcttagtatctcacaggactttggatttcttgtactcgcatgtcaacatttctagtgaggttgggaaatttttcatgcattatatcctgaacgatgtttcctaaactgtatactttctcttcttctcccttgggaatgtcagtgagtcgtaggtttgttctctttgcatcatcccatagttctcagaaaattttgtcttcttaaaaaaaaattattttgtcttcatttttctctgaataggatgattcataggactgatcttcaggctctgaaattctttcttctacttggcttaatttattattggggcttccagctgtattctgaaagctccacagtaaatttttcacttccgtaagttctgtttggttctttcttttttgttcttttttattatactttaagttctgggatacatatgcagaatgtgcaggtttgttacgtaggtatacattgcccatgcctatgtcctgaatggtattgcctagaatgtacatggtggtttgctgcacccatcaacccatcagctacattaggtatttctcctaatgctatccctccacttgctccccaccccctgactgaccccagtgtgtgatgttcccctcccagtgcccatatgttctcattgttcaactcccacttataagtgagaagatgcagcgtttgggtttctgttcccgtgttagtttgctgagaatgatggtttccagcttcatccatgtccctgcaaaggacatgaactcattcttttttatggctgcatattattctatggtgtatatgtgccacattttctttatgcagtctatcattcatgggcatttgggttcgttccaagtctttgttgttgtgaaaagtgctgcaataaacatatgtgtgcatgtgtctttacagtagaataatatataattctttaggtatacactcggtgatgggattgctgggtcaaatggtatttctggttctagatccttgaggaatcgccacactgtcttccccaatggttgagctaatttacacacccactgacactgtaaaagcattcttatttctccacatcctctccagcatctgttatttcctgaattttgaatgatcgctattctaactgctgtgagatggtatctcattgtgattttgatttgcatttctctaatgaccagtgatgatgagcttgttgtcatatgtttgttggccacataaatatcttcttttgagaagtgtctgttcatatcatttgctcactttttgatggggttgtttgttttttcttgtaaatttgtttaagttgcttgtagattctggaaattagccctttgtcagatggatacattgcaaaaattttctcccattctgtaggttgcctgttcactctgatgatagtttctttttctgtgcagaagctctttagtttaattagatcccatttgtcaattttggcttttgttgccattgcttttggtgttttagtcatgaagtttttgcccatgcctatgtactgaatggtattgcctaggttttcttctagggattttatggttttaagtcttatgttgaagtccttaatccatcttgagttaatttttgtataaggtgtaaggaaggggtccactttcagttttctgcatatggctagccagttttcccaacaccatttattaaatagggaatcctttccccattactttttttttttttgtcagttttgtcaaagatcagatggttgtagatgtgtgatgttatttctgaggcctctgttacgttccattggtctatatatctgttttggtaccagtaccatgctgttttggttactgtagccttgtagtatagtttgaagtcaggtagtatgatccctccagctttcttctttttgcttctgattgtcttggctttgcaagctcttttttggttccatatgaaatttaaagtagttttttccaattctatgaagaaaggcagtggtaacttgatcaggatagcattaaatctataaattcctttgggcagtatggccattttcacaatattgattcttcctatccatgagcatggaatgcttttccatttgtttgtgtcctctcttatttccttgaccagtgctttgtagttctccttgaagaggtccttcacatcccttgtaagttgtattcctaggtattttattctctttgtagcaattgtgaatgggagtttgcttatgatttggctctctgtctattattagtgtatagggctgtttgtgatttatgcatattgattttgtatcctgagactttgctgaagttgcttatcagcttaaaaagattttaggctgagacaatggggttttctaaatatccaatcaagtcatctgaaaacagagataatttgacttccgattttcctatttgaatgctttttatttctttcccttgcctggctgccctggccagaattatcaataatatgttgaataggagtggtgagtgagggcatccttgtcttgtgctggttttcaaagggaatgcttctagcttttgctcattcagtatgatactggctgtgggtttgtcataaatagctcttattattttgagatatgttacatcaacaccttgtttattgagtgtttttagcatgaagcggtgttgaattttatcaaaggccttttctgcatctgttaagataatcatgtggtttttgtcattggttctgtttatgtgatggattacatttattgatttgcatatgttgaaccagccttgcatcccagggatgaagctgacttgaaagtggtggataagctttttaatgtgcttctggatttggtttgccagaattttatcgaggagttttgcactgatgttcattagggatattggcctgaaattttcttttcctgttatgactctgccaggttttggtatcaggatgatgctggcctcataaaatgagttagtggggagtccctcttttactattgtttggaatagtttcaggaggaatggtaccagctcctctttgtacctctggtagaattcggctgtgaatctgtcttgtcctaggcatttttttggttggtaggctattaattactacacccatttcagaacttgttactggtctattcaaggattcaacttcttcctggtttagtcttgggagggtgtatgtgtctaagaatttatccatgtcttctagattttctaattcatttgcatagaggtgttaatagtattctctgatggtagtttgtatttctgtgggatcagtggtgatatcccctttatcattttttattgggtctatttgattcttctctcttttcttctttatttctcaggctagcggtctatctattttgttaatcttttcaaaaaaaccagctcctgtattcactgatttttttgaagggttttttgtgtctctatctccttcagttctgctctgatcttagttatttcttgtcttctgctaccttttggatttgtttgctcttgattctctagttcttttaattgtgatgttagcgtgtcaattttacatctttcctgctttctcctatgggcatttagtgctataaattttcctctagacaccgctttagctgtgtcccagatattctggtatgttatgcccttgttctcattggtttcaaagaacatatttatttctgccttaattttgttatttacccagtagtcattcaggagcaggttgttcagtttccatgtagttttgcgtttttgagtgagtttcttaccctgagttctaatttgattgcactgtggtctgagagactgtttgttatgatttccattcttttgcatttgctgaggagtgttttacttccaattatgtggttgattttagaataagtgctatgtggtgccaagaagaatgtatattctgtcaatttggggtggagagttttgtagacgtctattaggtctgcttggtccagagctgagttcaactcctggatatccttgttaattttctgtcccgttgatctgtctaatactgacagtgtggtgttaaagtctcccactattattgtgtggcagcctaagccttcttgttgcattgatccctttaccattatgtaatgccctttgtcttttttgatctttgttggtttaaagtcttttttatcagagactaggattgcaacccctgctttttttttttttttttttttttttttttgctttccatttgcttggtcaatcttcttccatccctttattttgagcctatgtgtgtctttgcatgtaagatgggtctcctgaatacagcacactgatgggtcttgactctttacccaatttgcctgtcatttagtccatttagtctgtttacatttaaggttaatattgttatgtgtgaatttgattctgtcattatgatgttagctggttagtttgcccattagttgatgcagtttcttcatagttttgatggtctttacatttttgtatgtttttgcagtggctggtaccagtttttcctttccatatttcgtgtttccttcaggagcccttgtaaggcaggcctggtcatgacaaaatccctcagcattttcttgtctgtaatagattttatttctccttcactcatgaagcttagtttggctggatataaaattctgagttgaaaattcttttctttaaaaatgttgaatgttagcctccactctcttctagcttgtaggatttctgcagagagatccaatgttagtctgatgggcttccttttgtgggtaacccaacgtttttctctcactgcccttaacattttttctttcatttcaaccttggtgaatctgacgattatgtcttggggttgtttttctcgaggagtatctttgtggtgttctctgtatttcctgaatttgaatgttggcctgtcttgctaggttgaagaaattctcctgtataatacactgcagtgtgttttccaacttggttccattctccccgtcactttcaagtacaccaatcaaacttaggtttggtcttttcacatagtccaacatttcttggaggctttgtttgttccttttcattcttttctctctaatcttgtcttcatgctttatttcattaagtccatcttctatctctgatatcctttcttccacttgattgaatcagctattgatacttctgtgtgctccatgaagttctcgtgctatgtttttcatctctcttaggtcatttatgttcttctctaaactggttattccagttagcgattcctctcatcttttatcaaggttcttagcctccttgcattggggttagaaattgctcctttagttcagaggagtttgttataacacaccttctgaagcctaattctgtctattagtcaaactcatttgccatccagttttgttctcttgctggtgaggaattgtgatcctttggaggagaagaggcattcttgttgttggcattttcagcctttttgtgctggtttttcctcatcttcatggatttatctacctttggtttctgctgttggtgaccttcagatggagtttttgctatgttgtccttttttagatgttgatgctattgctttctgtttgtcagttttctttctaacagtcaggcccctcttctgcaggtctgctggagtttgctggaggtccactccagaccctgttttcctggttatcaccagcagaggctacagaacagcaaagattgctgcttgctccttcttttggaagcttcgtcctagaggggcacctgccagattccagccagggctctcttgtatgaggtgtctgtcaacccctgttgggagatgtctccccatcaggaggctcatgggtcaggaacccacttaaggagttagtctatcccttagcagagctccagcgctgtgctgggagatccattttctcttcagagctggcaggcaggaacgtttaagtcagctgaagctgcacccacagccgccccttacctcagttgctctgtcccagggagatgggagttttatctataagccccttactggggttgctgccttcctttcagagatgccctgcccagagagaaggattctagagaggcagtctggctaccatggctttgcagcgctgaggtgggctctgcccagtgtgaacttcctggctgctttttttacactgtgagaggaaaactttctactcaagcttcagtaatggtggatgccccttcccccaccaagctggagcatcccaggtcagcttcagactgctgtgctggcagcaataatttcaagccagtggatcttagcttgctgggctccatggcggtgggatccactaagcaagactgcttggcttcctggcttcagccctctttccaggggagtgaaccgttctgtctcgctagcattccaggtgccactggggtatgaaaaactcctgcaactagctcagtgtctgcccaaatggccccccagttttgtgcttgaaacctagggcccttgtggtataggcatccaagggaaaccgctggtctgtgggttgtgaagaccatggtaaaagcatagtatctgtgccgaatagcactgtccctcacagcagggtcccacatggcttcccttggctaggggagggagttccctgaccccttgcacttcctgggtgaggcaacaccccacctgcttctgcttgccctccatgggctgcacccactttctaaccagtcccaataaaatgaattgagtgccttagttggaaatgcagaaatcacccaccttccgtgttggtctctctgggagcagcagactggagctgttcctattcggccatcttgtctaggaatctggttctttcttaacatagctatgtcatctttcaaattgtggatgggttttatggcttcattggattaggtttcaactttctcttggatctcactgagtttcctcgttattcatattctcaattctgtgtctgttatttcagacatttcaatctggttagaatccattgctagggttctagtgcaatcctttggaggtgattaaacactctggatttttgtatagctggatttcttgcactgattccttctcacctgagagagctaatgcttcttgctttttgattttttattcttgtctcccttgtgagtatgattatggcgtatgttgtgtataatcaattggctttgtgtctttgtgtcttcagagggccaaggctctgtacaggttcctttgttgcagatgggctcctttggggagtttcacagttcgtgctttttgcagcaatgtttttgttatgtggtgtaattcaggatgaattctactaggtggcacttaaaactaagagccagcagatagacactgctgtgttcaccctctgaggctacagagaagggtgaaaagtgccctccccaagcttatgctcatcttcagccagggtggagtgtctggagaactgcgagaagtggccacttccactgcagcttacttaccccaactagaagagctgctgcctaaccatgacattgcactgggtaggggaggcagggcgtgagagatgaccccctttctaaatccatttccaggctttggtggtgcctacttcagtgactagagctgtacccaggcttcctttgtcccaaggggggatttagtgggccttgctctaccctaccttagggcctcactctcccctacctcagggttagaacaccagggaacctgcaactcctgagtgacctgccagtgtcttgtgcttgtagagtcggtgtgtgttgggtatgtctgcaggtggtctggtgattcagtggctcagagttcgaagatccctggacagggcagtggccacgtgtacgcaaccagtatgacttctccagcctgggcttttcagcctagcaggtatccatggaggctgctcagctcatgctcccctgacctggtgcatctctttccaatatccaccctgcagcaggcctgactggctaggcttttcccaagcctgcactcagattgctgagctattccagatgttccaagggtgggactcctggaggagaagccttgactatcaagccatgcccttcccagtccagttttgtgaaggaaggagcatcctgctcccatgccagcgtaagaaactgcactgcactgtgttctgtgtggggcagtggaggctgtgctgtgggcatcttcttgcaggagtggccaggcaggcagtcttaggaggggccatgaagtaagtgggcatgtggatcagatgcaccttggtcccatggcaatggtgatggggccttggtgatgggcacaagaacatgtccagtccctgcaatttccaagcctggcagacagcaggtgctgcaaccactctgtgcaagatggagagccttgggagatgggtgcctatgggttgtgttttgctatagttgcacagcacagggaagtctctggagtccatgagggttcaaactacacctctgcttgttctccagttgtctctccctgccaatctaaatgtccatagggtgatgggaactcctgtagctaggatatcaggtgtccacaacagcaatatggtgttctggagttcttttactcacctcttccttacgtccaatctgggtgcaggggccagtccaggtgctcagtgactccaggcaggctgccatgcttcctccctcttcaagcatagtgtctgtgtcacctaactattaatcctctgtgttttctctcaaatgatctgtttgaattgcaaaggttttctcaatattttggtgcctctctgtggaagaggcatcctccagctgcttctagttggccatcttgcccccagaaaccttatgttaaatatttaatttgtcacaaaacagaatttaatcataattttacttcagctgaaactaattaaaattatttcagactgtctcttaatcaggagaaattgtcaaacgtgtctgttttctcaattcaaaatgagagaagcatggaaatagattttgaaaaaaagattgatgaatttgcttctgtaaaagctagagttcacatatttccttatgcctccagttccagcctggctccataaagcaccgtgaggtatataagaactttttttattaaatgattcaaatgctcccaaaaagtgagtgtgtgatactatgaaatcaaattaaaattctaggcaaaagttaaaagtaacatcaagatgattgtattatattgataataaagatgtgacatttatgtgcttttaaatgtcacacaatatactaccaacataaatatgcaaaacatgtttaaaatgaaagaataatagaatgagtaataattataagattaacatctttatattagtgtatgatagaacataatccactgagatagttttaaatatagagtgaaaggtataatttaatggctagatatcaaattagacaattttttaatgcagtaaattttaaatagcagcaattatacaaactattctctgatagcaaataataaaaacaaataatatatcaaccaaaaagtaaaatgagaaattacatcctgagtcagcaacaacaacaaaaaatcttataaggaggttaatgcttctctgttagaatatctgaaagaatggagtaagagtagtaattatctaattagaaatgcccacagccagaaaatgagcacagcttcaaagttgtgatgtcaactatgccagaagttttggaatattttatcaactataacaagagttaagtttataaaagttaacatttaaattatcccaagttgtactgaatgccattctcataatagttaacaatgttttattttaaaaagtgagagaaatgaagaatgaagctaagagaacaaaaagagaaggaaataaatgttctttcttaatattacttatcagaatataaatgcattatttattataaactcacctattccctttggaaatctgctaattagacaaccacagaatgaaaaaatgtgaattgctgtggaaaattttaagcatcctagtttggattacatgtttccatttgtaagaggaaatgtatatattgtgtttcattgccctagaaagatttcatgataaccagaaatacattcttaattgaaacttctgtatatgcttttaatacattatattttatattttttagctatctacctataaataaagctaacatctcaaattagaaaacaaaaacaacaacaaagattattttatgtaaccgtcttttaaaggggtataaaactctaaatggacttcacgacaattcagcaaactgcaaattacaataaataataaatgaacacaaggccagatgaacagaatgtttctcagcaagaggaatgtcttacatatttcaaaatacacatgcctataaaatcatttaactgctatgcctaccatttaaataatgaggtgtttgattattactaataagcagtttatagttctgaattgtgcctgggactgaaaaataaactgttttatcccaggagttggtaatgttttaaaaaataaagccacacagagccagaggcacaaccagaagctatcaaaggagctggccattaggtttccatctcactttgaagattgatttcactagtgctaggagcatcagaaaagcagctaaaagcattttctactttccatttccactgtttacccttgaaggtctattaatgttctcttgtagccttcaggtattccatggacatggcagcagagctcttcattatctactattagcctccagaactgctcacaataaaacttctcatcaaacttggaaatattaccaaacttgtgaaatcttatggaaaatagtattctttagagaagtcaaggagactcaccatttaagaccagttgctgtgctggttgctgatctgtcaagaaaatgtaagcatttagccaaaggtgttagcttaacatcgtatcagtaaagaggcagaaatatttggggataatttcagtattgaaccctgtttttttattagattaatttactctgaaagcatcctcaaaaaaatggggtgaaagatctttgaatagatttataatagagactttgaaatatgtgcttgtgcagaataagttaataccatctacagtgctgtgatcctaatggatcactttattaaagcatcagaattctggaaatgtgctcattagccatcatgtctttggtaaaagtctgtttgtttccagcagggctaagttaatacagtagcagacagagtgaaatatcaacttattattacttgtcaacattgggttgtattcgtttttcagattatttagctggctaggtgagccctaaggcaaactcttgaatacaaatattctactgctttatgtatatgaaaattcagaactcgggctccaaccagattgtgtgatgccaaatgcctggatcattcttccattacacagcctcaggcccttaaacctttggcctttgcctggacatagaagattcctctgtggtaatggatctccattgactacaccacagaacctaaaggttaaactccttagcccagccttccaggctctccagaatctggtgtaaaactaggtttccaatcttatatcccactctccataccctccatgatagccaaattgaactattcagccatatgttgacacaaagatctgctttttgcctgtctttgtgctgtttgctttgtttagggtcctttcttctgaatttttttgcacgcctgttaaatgttacacattgcaacttatattgtttttatttgtagcacacacatatttacaagcacaagcttgcacataaacacacacacacacacacacatgaatgcaacagtacttaaacttgaaaactttgggagagttgttattagggatgaaaattgttcacatggcttcagtgaggcaacaaagctctggaagtccaagatgaaactccatctcaagagtttgtactcttagatgaaggattatatatgtaggctgggagcatgtctttttcctaatttctgtggaattatattgataagaaataaatttagaaatattgcatctttgaagcaagatcattggattctagttatgactcatttatgtaaattattaatttattaataatttatattcatataatctccagatataactttttaaagcaaaaatttgatgtttttaaaaaccagtaaaaaattttaaattacaaggaaaccataaccaaaaaatagagtggtctgaattttctctaattccccaaacaatgttggtcattcctttattggaattctcttcacactttatgcactcttaaataacagcaatcttcaccctgcagagtatctggaacagctcttacacccatcagttggtgaattacttaaaaaaacaagccaagcatcttattctttgtttctctagcacatggtgtaatacaagaaagaaaaatatatatattaaattaatgatttaaatattgatgtccgaaaaaaagtatttttaaatacagtatgtctctttaacactaagaaacatttcctgttgggagtggctagagataaagatctttttctctcctctagtgaggtaagttttctgtgatattacctgcagaaataatgatttccattataaatgaatgaattcatatttttattctgctctttcacattccttgtggggcatttctatagcagagaccctctacatatataatggtatgtgggttagggaaatagaaatactaagtaataaatagtttgaactgagaaactgactctgtaggcaaaaatgctgagagccataccatgtaatagccaacagcacactcgactagaaacactattccagtctgctgttttgaaactgatagtcttgtgttaattaggtacagaattcagtagagtgtggaaagactacatatctacaccctatatatagtaaccagtagcgcccagcctcattctttggctttaaaggaatcagttgttcttaatgaaataacttcacagctttcaggacagaaggctggattacatgagatttattctgtgctcccgccgttccttattcatacttctgttttaggacttacatttactgtcaccaaaaaattatgagtctctctagggcagacccatttacccctagttgtgtcttatacatgttcactctttgtttgtttgattcatttatttttgtttaattgtgctgatttattgtggagcttaaaaaaacatactgcttccctttctttcttctctttctttctttctgtctttctttttttctttctttctctctctctctctctttctttctgtctttctttttttctttctttctctctctctctctttctttcttttctttctttctttttttgagatggagtttcactcttgttgcccagggcagagtgcaatggcacgatcttggctcactgcaacctccgcctcccggtttccagtgattgtcctgcctcagtctcccgagaagctgggattacaggcttctgccactagaccaggctaattttttgtatttttactagagacagggtttcatcacgttggccaggaaggtctcggcctcaggtgatccacccttgtaggcctcccaattacagctgttagccaccatgcccggccttccatttcttttgaggaaaaaaataatagatttcacatccagagtaaaaagagcactccactaggcttaaaagacaggtacttcctggcacagtttgttatcaagactcatagcctaatcttggaaataccacttcagctttctggttcctgtgtacacaaaatgatgcattgagttcaatggtctctaaagcctcttcttattctaaaagagtacactttgctgttacattaacgttaatatgcatgttgttttatgctaatacatatgctttcatggcttgagaacttttttccaaatcctttgaataaagcagatgagcaattcctttcagatttttttcaagattcctttatacagctttgttaaaaataaatttacaggggattctgaaagaatcatgataatcatacgtaactctcaatttcatacatttatatatagatgcattacttatttgtctagccattaacatgtatcggcattttaacagtgggcccaaaaagaacctctccttcatcagaagtctatttttgtaatgtggtcatagtctataagcactgcaattgctttacagagcacagatgtttttcttctttccaccttgccctactttttaatagtaatttaatatgtattataatcaccagtatttcaaggctaaatttttgctagaaaagagtatgtaataaaaaatgactatgaaataaatggggagtttataaaagataaagtacaaacgctcgtgttgtaggttgaggcaatactgatttcacaagaaaatctaaaagaattgtgaacagacgagaagtggtatggttgtaaacaatggaatggaaaaccaaatatcacatgttctcacttataagtgggagctaagctatgacgatacaaaggcttaagggtaaggtaatggactttgaggactctgggggaagcttgggtgaggggtgagggctaaaagactatatattgggtatagtgtacactgctcaggtgaggggggcattaaatgtcagaaatcatcaccactaacgaacttatccatgtaatcaaaaaccacctgtacccccaaaactattgaaataaaaaaatttgtgaacaaagctaaggatgttttaagttcagtgaataaacctaaacaaattaatatctgtttttttaaaaaaactaaagagtgctattcagattccactggataactgtatacattttagtttttttgacttattttaatatgcttgcattaaatcagaaaaatatttttaaatgcagcaattggtaataaaatttcaaatgctttaatgtctcctttagctaaattatgatctgattactgctctaaaatggaatatcagcctccacgtttaaaaaagtctttatatgcttttagatatgttttataacatgtataaatatattttaaataaaatttatactatatattagcataatttcttaaggaatcaaaaaacagtttcatcatcactgaagcagtatactgtatattatacaatcaagataattataatttattattctgataaattcacagtacaattttattaaattaaatgttggtggtctccaatacccatcactgtattaggcagtaaaacaaaaataaacaagcataagttaacaacaagttaaattataatacaggtggagcatccctaatccaaaatgctccaaaatccaaaacattttgagtgctataatgccacaagtggaaaattccacatctaacacctttgctttctgatggttcaatgaccacaaatgtaattttatgcacaaaattattcaaaatgttgtttaaaattaccttcagtctatatgtataaggtgtatatgaaacattaatgtatttcatgtttagacatgggttctaccaccaagatatctcactatacatatgcaaatttgccaaaatccaacaatatctgaagttcaaaacacctccggctccaagcattttatataaggaatactcaatctctaatattaatatctgacacttgaacacctacaggcactgcccatgacaatttataaatatattctattttaatttatttcttacaaaattttgagatacaaacaattaattgggaatcagtgtagtaaaattacctgtcaccgttatccagctaattagaggagagtttaccttaaagagactaaagcccctcatttccacagacaccttctaaagccctgagcaggggaggactctgtagtgcatacattactatatgttgtctttttaaaaacttgtaatttgtgtctattttttatcattctatatgcaaattcattcttgttccatattttgtattagtaactttacgttcttttttctgagggggcccccaaattgtacaagcttttggtcccacacaacctggatctgtttttgcagctaaaaggtgactgagccagactccaatctttgtccaagaccgtgcttttatccactgtgcctcacagttttagagagctcacgctagtaaagggtattttatgtgtaaacaactaaagattacaaaaggagataagtgttccaaaccccttatttcacaatattgtggaagggtagtaattgtcacactatagaaaccttctttgaaaatggatgagaacagcttttgagtgtggaatgtatgtggcaggcagatggagtgaggttcaattaaggacacaataaaaacccaagtcacatttgccttattttcctctggggttttaggtctcaaccttaccacttattagttctactcgtaccatatttattgaatttatatgcctgaaaagctgttctacagctggcagggtctgaaaattattggcaattaacattaatgggcaggaacattttcagtggaaattaaaaaatcctttggcgtcatagcataataactagatcagagagttggctcttccaacattcacattttctccttggaaatatgctttgtcccatgatcttatttaagtagaaagaaccgataatttttttctttctttatttggatgtaaacatgcctatgccatcaagaagcagccaagtaaaccctgcttgacatcacagacaaagcctttgatgctgtgttacctgtggaattggtatcgatatctcctgtattgtgaaattctataacaagtaacaggccagtcaatttaatacctaagccaccctttcccttttctttgatttgcatccatcttattagaaagcgacaccatcttattgattccattcaacctttgaaagagaagataaggaaaaacaaaaatgtgacagagataagaggctctcaaggttatccatggatggtgtttaaaggaaaggattgtctggggtctcagtaaatggtgttaagggacagcattcagaggttagaaaaagcatcttaagcttaccatcatgtacttgagaatctgttctgctactcttttcttggtagttatttaagtgctttggaaagtatgtatctgtcatcttttatgttcctatgtgcaaagctgattacaatgatattatggttgatggccatatacaagcttgcatcagtttcaatggctatttgctgctctttactgactgactaaaatgtcaagtgggatttcttatctctagaattttctcttttagtaataatgttactaagcatgtgatgtatttattctaatacacacaacatccctatgaggtatgttctcttttcttcttcataaaagtaaggaaattggtgcttatgggagataagtaagcaaaccaaagaagtatagtaagtaaaacacaaacccaaatctatctagtaccaagtctactcccagccatctgttattcgcactgctgtagattttattttgctgtaagcagggacaacatacatatgttttgaggtacttcaagaactctatttattcttctaacacataatttcttggtcttcctgaaatgttttctattagaaaaacttattgaatccttcgtaaaaggatgtgggtggcagggactgaggaatatcaatataataaaaagagtagataaaaaggcaaagaaggggagattcagattctagacttaatgttactcagaagtaaaagatcccagcaagttggagcacttctattttcactctaacatgctatatcttttaaataaatttatccttatttattattttaaattaagggaaaaatatcaaaattgaaaataaaattaaaatccagtatcttacaaggccaaaaaatttaccattagcacttttcaaaatgtcattccagttatgtttttgaccaacaaaattgagattcttgtatatatagtcttatatcctgtacttttacccaacaatatatgttgagtagttcttattttattacatcaattgactttttaaacattaaaaccaaccttgcattctttgagaaagctccggttggttgtgatattttatccttttgatgtattgtattggctttatgactgcattaaaaaaaatttgcatccatgtttgtcagagagactggcctctaattttcctctccttgtaatatgtcttctcagatattgggacaaggttatttctgactctacaacataagctcataaagattcccttttcctctatgttctggaatatttttgaagttaaattatcatgatgggcttcttttgtttttgtttttgttttctgcttttttcaccctttggatgtttggatgaattaaccaattaagttatcagggccaaacattttccttgcagacatgttttcattatagattgaatagacggaggaacattaaagttttctacatctcctaatgtcatttttgataagtcatatttgtctaggaatttatttcatttatttttcaaacttatgtggcataagatttgtcataataccctcttatttttttatgtctgaagaataaattaaagaagaatctccttttttgtttctaatattagtcatttatattagtagttatcaattagatttatgaatatcagtcttttaaaatagtaactttgttgtatatttgatttccatttcattaattaagtttttactcttagtatttctctctttctattttctttggcttcattttattattctcttctaatttctttatatgaatacttagattgtagtttgtagtttttacagccttctttcttacttataacttaagcatttaaatgataagttttcttattctagctttatgtcacaaattttaatgtggcacatttttattttcatatgccataaatatttttatatcagttgtgactccttctttgatccatgtgtgtttagatgtgtgctgttaattttagtcactcaaaacatttccacttgtctctttgttattgatttatagcttgattccaatgtggtcagagattatactctttctaatttcaatcctttgaggtttattgagatttactttaaagccagcagatgaccaatcttggtcaatgttttatgcgcattcaaaagaaatggtattcgttatgcagtactgaatgcagttttgtatttatatgtgtgtgtgtatgccaattatgttattttgttaatcatgttgttctaatcttctaaattgctactgatatttctttacttctattagttaatgaaagaggtcttacagtatcttgtcataattactgtatacctctctgtatttctcctaaatctgtccattttaaaatacgtttgagatcagatgttattaggcacatacaaatttagaagtgattcatccttctggtgaactgatacttttatcaattttattaaaacttaccaatctgtattaaatgtctgtctttaatgcttttttcttaaaatatactttgatattaatatatctgcacaagcttctttattcttataagcaatatatagatttaggttttggttttatatccagtctgatcacctttatctgaccacctgggatattcattcaacttacatttgatgtaaattcatgtgttttggtttcaatatacatgttattatttattttttattttttccaactcttctatgtatctttttctctcctttctttctctgattatttttattagccactatttctcatgtaatagctaatcctttggttattctttcaatgatttgtgtttagctttccttcttacagtcaactcaaaattaataattctatcacatcctagaaaatgcaaggaccttaaaactctgcctctgtttatcttgtcttccattgataacactcgtagtgttgtgtgttttaattctatacacatttaaacctcatgagtcatactatcattgctttatgcattcaatattcactgggatttacctgttcagtttttatttctttctgaataccatcttcttggacatttttctctcttttttcttcttaattcaattgtatcttaaagatttttaccatgtcctatatgttctttttttcaatctttgtatcattctgtatatttttgaattggattttctcctattcctccaattcttttggtgcttaacctatttgttaagtttttaattcagttacagtgttttacactttttttgcttttttttgcataaaaactgattttgcatttttctatttttaaaatcaattactcttctctgcttaaattctccatcatgtttaccatttttctggaaaacaatagtcacagttgttttaaagtacagatctgatagctgctgatatctagctgtcctatatctttgtattcttagcaattttgcctgaatttgagccattttgataaataaaagtgagttgtgtataatttatataatcttccagataaaatttatatttgtgtttggtgtttagctaggttagagagagatcaccttaacctaatctgaaattcaactgattataagctgaattttagtctttattaaagatgatttctttatccacaggtatagccttttgaaacctataactgatagcctgggttacttaccatggttacttcttcctgaaacaattacatcatatttccttttaaggtccattctcctgctaaaagttttgttcaccttcttcacttcttggccatagtttaataattgggaaatacctccagggtaaaagttgagacaaatcactatcctgcacttcatttttgtccgagatcttggctcttcgagtccttgctgcattaatatgtctctgttgttttaaaatagatttttaaacatttctccagcttttctaattgttctccttgggacgtttggtctcatacaagctagtatgccacagttagaagtaaaagacttctttgttttaaaaacacatttgctcatattctaatgtcttctggttatgacaagtttgcatttttatatttacctacttaatccatatgtaattttttgtggtatatgggaccaggtagagacttaacttctttcaaacaaaaattaatcaggaatttcagtattgttatttaatttctattcagtttcatttcattgttaatgtaatgtatcacttttatcatatatacatttgtatgtgtttctgtatattttattatgttcttctcttgaactgtttttctattttttcttgggtgttacacttctatttcacatgacatcaaaatatggcataacataaaatcatgtaaggccctatattattactttgtttgtaatgtttatcttagatattccagaattgttttataacatttttatttaatttatatcaacctgaattttctgcaagtctttgctttgttattgcataagaacttttgtattccttacttaacctaattttccaaataggtggaatgctgcaaaagggcagtaaccatatctcttttgaacatcagagaatatccagtgcttagcacagtacttgacatagttgttactctctatctgttgaaagcagaaatgagtttgtaaatttttctaggagaaattggctttcttgctatattaattctttacatctagaagcatatgtgtttccattcatcttgacataaatatcttttttataaatctgtgtacattaattatctgtgcttcttaaatttttaatacacatgtaaattaccttggaggtctgtaagaaatatagattcttaatcattaggtctgaggtcaggcctgagattctgcatttttaatacattcctgagcattgccaatgtcctggttactggatcatactttgaatagaagggtctagattcttagacagaacatctagcaaaatttgtattataattgaattaaggtagtgtgctcattggaagagatttcacctcactaatgtattaacagtgacacatttttctaattaagcagctggacattttattcatttaactcattcattaacagtatttatggaataccaattaatatgtgatctgtactatcctaatcactggaaatagaaaaataacaagaatgtacccaccttcaaggcactagtaatctaattaataagagacagataattgcaacacactaagtgctacaataaaataatatctattattataaataataatagggaagagatctatctgagagaaaatggtatagaaggcaattgtgccaaaacacaatatcaagagagaatgaaatacaatataagtttacagagtgaagtacaggtcagaacgtcgtagaatttataggtcatgctaacaagatttccttaaacctaagagcaatgagagggcatcagagttctaagcaagaaagtgacatgaacaaatttgcatgttgaaaagatttctctgaccgctcggtgcagagaacagatgagaagtggacaaaagtgaataggtgatttgcaattttagaagtctagatgtgaatatagtttgctccagtgccttttagcacattcataaactactgtaaccaaatgtgtaactgggatctaagccactcatggccaagcatttacataataaggaaatcagtgacaaatgagtaataactggaagagttggagattaattaaagataggagtgtctgtgtgtgtgtttaagtgagttcaaaacctaaaatgtgtcatgtatttttctttcagaaatacctctaaaagtgcagtttgagtcaaagaaatatacccacagttgataattccctcctttcttttcactcatccttttaggcatacactatatttattctgagttctgctctgaatcttaagatacagtacatcttacatgtgctcattttcttttcaagagaaacaaaacttatattccagaagctacagatatgccagagacaaaggaattcccacactagtagcctctgctttagaattccttatgtcatgaaaaccgcaagaaatcgaataacgtaagactggaatttttagggtataaaatcctgaaactctgcttatctacagttaaatattcagcctttggaaatataagtaaagagtcccctaggagactgagatttcttgcgatagctgtaaatttcaaatcttaggggcagtgtttatcacatggagaaaacaggatgctttaggaggatagaacctatgaaaatgtaacacaccctcagagagacattgtgacactgaagaaaatgccattgaaataataagtcaaccattaacaccatctgagtgaaaaaaaaggcctatctggaggaaataatttgtattccatcacttcttgcagtcatctttgcaagtgtattagcaagtgacaaacacatctaaaataaaatacacgtgatagacacatccttctgatgacaatgtctggaaaaagaaaataaaccagtaggaaaatcatgttaaagtttgctgttatgtcttcattttcaacaataataagtgactctctcttaaaaagaaatagtcacacattatatttgaattgcctaatgcctttcagcagctgcttcagttttgaattagttttcaggcacaaatttctttaacctatgtgttcatttttctcactaattagcccggtgatggatgcattttttatgttcgcctcactgactgctggtcccttgttgaagctagcagggtggcataccatctagtacttgactttcattgctgtcactttctgagtgttctataaccttgacctccatagctcaggtactctatttcctagcctcttgataactcacacaggaatgtaaaaatattatttttaattcagaatcttttcctttgagtacttctagaaacagctaccttctgctcattcttgcagttcaccaagaatttattaaggagcaataccaattatatcttaaatatgctttaaaaagtgctttcataactatatttactgtcagtctagcactatagtgggaactacaaaaggaacgtgacaaagttcttatctgtgaatggtttaaactcgtagagaaatagatttgcatatgttaaatacttggtgaacaatagaggatacaatataactatgtgtcaaaacatttgggacagataatgtgagaaatcctcttgaacctacataacttaagagtgtaggtgagcacaattaaagcaggttattgaaggagagcaggatatacctatagttaggcattgaagagtatattagtcaaggatttacccatagtaatggttccacaccttctacaacctgattccagggtccctgtttctttcccatgtctatgctccactgcctatttacacagcccgtacttgctgtttttgtttatatccttccctattcctggaattctctaccttcacaattgtacctaaacaacctcaagtcccatgatttgcattcctacctatccaactcaaatctcatgatttccaccaacttgtgagttctactaaggatttaatgtcttctttatgttctcagtgtacttattttcccccattctgactggaatcacaaagctcacactgctatgtatacatattcaatattaataggatacatggcaaagagctataatttaaagcacatttttaaggctacattgctaaggcatacatcatatgtctgcttgtcctcactcttcaagatcatgactgtaggacacaatgtaaaatttaatacatggcagtcttaacaattgagtaacatggaatttacttcagaatttgctgtgaacaatcaaagttaatctttttctcttcatcatactttttaaaaaaggaaaataacaaatgtttgtcctttgtttttctatattaaaaacaatttgatttttcttacaataacatacatgaaagaaaattcctctacaaacccaccttccgacttcaggtatttctcaactcagaaaggtaatgagtaaatgaagagagaagtaattctgactgatttgctggatgggcaatgatatgttgatgtttaaaattctagacacacataatattttttaaatcaaatggaatggaatggttaagttaaccagatattgttatgaatgagccgtaggtactaattctttttatttaaagcctggtttttaaaaacacacatgatctaaactaatgcctagagtcaaggtgtatttatccaaaagataatcattaaaaataaattccggtagagaacgagatctagataatccaactgcaagctttctctatccctctggtgtgtcctagttagcctggagaccatctgtgaactgtgagcccctatgaccgttgtaccttagcagacaatgagcatttggtagtgaatgcccacaacatttttagcactggaactgattcctgtaaaaataatttaatttgttgtgagtgcaattttgatttaaataattttcatttgtttccaagagagtgctgaatgatgcagatcaatatgtaaagcatttgtcatgcattcactcttaattccttaataacattgcacacaacaccttgtctaagcataaaaacatataatgggcatttatcttcaaatgcaacctaaatgctgtcaattttgaactgtaaaatggaatattatagcctcctgaggggaaaactttgtgggtgtgataactgaatacgtgacacctcaagaacctgtatcagtgaaggctgctgattaagaaatcgggaagaattcagaggtgaaatgaagatctagttcctcaagtcagcctctggataggatttgttgaaggaataagtactcaggcacagggttttcaatatgtgattttgtccttaggcagctgagttgcccaagcaattatgcaaacaatgaccatggcaagtaaatttactacacagcacagtgtaaatcaaggaattgtgaacctcaatagaatgtgtgtgagatgacttagcagagtatttagagatatttggagtgagacttaccatattgaaatggatatgaggtcatttgtcttttttatttcaaaaagaataaaagatatatggaggtggtcaggtattttatgtatttactgtttgtctactctgttttattttctttactagttttcaaattgttctatgacattattgtaaaatctagcagtgccccagaaaagctacatgtctaatgttaagacaagagtcttattaggaagaaggaacaaaaacaagagtatttagtttggaggtttttaggagttgaaaagctgttaggaatggggttagattagaattcttagagaagaagattttataggcatatgagaaagaaacctctagtaggtgtagctgtccaacaacagagtcagcaactttgctaaacaatgagctctgtcaccagaagtgttccagcctgaaaaaacatctttcagtgatacacagaaagactgtgttacagcatacttgtggatcctaacaaatcacagattctaaaataaataatattttttatcataatttacttaattatttatggaacccagaagcactttgataatttacaaaaacagtttaagaaatacaatcccactgtgagctattcatctgaattataggctcctaatgttgaatgagagactgctaagctgagaagtcaggacaccagggttctgaccctggcttagataatgactgtattacctgtatttaacttctgatggttggaagatcttggctataaaacgttgcactattcatcatcaagacatccttcaggtttaaattttacaatttccttcaatatgcaactgtcagctttcatattccttatcgaacatttgccttagtttattctctattatattcttggaaccaactactcagtaaaccatgtgtattaatgccagagttcgatttcagtagatatatgttatattttaaaatgcatccttactgtgatttttcaatcaagcgaaagacatgtattattcatctgcatgtgtcttcaaaaagactaatgatgtgtcttgaaatacagattggccacataaaccaatactaatatattttttaagttatggctatttaatacttgtggaatttgtcagcttacacatagttcccacacatagaaatttaatatcgaaggagaaatttatatccatacacaaacaagtatgtatagaaacaaaactaagaaaatggatgttaattactgactccctaattttgaataagatctattgcttcaggctaaaagaagatttttctagttagagataaaatgtcgtgtccacagttattaaagaacaactaacacaattatatgcatcttcaacactgctttattgggtgacattcctttgaagttaagactgattatctgattttattaatagcacatcctttcatcagaattagaaatactcaacattgatcaaatctagttatggcattgtattttaaacttaatgtaggacttttaaaaatatttgccatagtttctaagctaaaattgttgtgtgaaaaacactgatcaaagaatctaattcttaagaaacttggaagtgtatagattatatttaattatcaaggtcccagaaactatacaatcctcaaccctagaattcagattataaattatcagagattcttcttttagaaaaaaatatctctcaactttgagttcctacacagaatacttggattgtgcttcttcttctcctcaatgttcagtgatttagtaagaacatagaagacaatctaactataatattatatatttgtgaatatttttactcaataataatcaataaactattaattcaagtgaatgcagaaaagaaaatcaatttcattgtatttttatagtaacattatgagaagcaaacagtaaggtaaatgcattgagaatgtttgatacttattttagtgcacatgactacgatgggttttcttggcaaaatactggtataaactagacttcagccaattcctgctattgtgcttgttgaagaggttacttttctcattgtgtgtacaaaactgattgctggctggcctactcaaaagcataactgaagctaggtgcaatgacacatgcctgtagttccagctactcaggagactgaggcaggattgattgagcttaagacatccaggatgtaacgtgctatgattgcacctgtgaatactcactgcactacagcctgggcaacatagcaagactctgtctctggggaaaacacacacacacacacacacacacacacacacacacacacacacacacatatctgggagtggatctcggtgttcctctctgggcttggaagctttagaagagtgtttcttagaggaaatggttatgagcaaattggcttggggacaaaaccctgaagtcaaacaacttgagctagaaaatctccctctactgctaaatagttgtgtgacatgggtactatttatgtgttcataataagcagggcctcttaaattctcaaattttgaatcagcaaaataataaaaaataaaataactaaacaaaaatacaataactataaaaatagtcagtaaaataactattgaaataatggtagttaaaacctgtatggcagggttgttgaaagatgcagatggtgagaaatttgcaaaaacaatacagtgtcttctatagaataagtaaacaataaatgccatataaatctcttgcttatagtaagtaagttgagaagatgttactaaaaaattaagctattcctcaattcgctttttttggaaattaaacatttgcattcagattgttaactgatcacctactgattatttttcctagaatcctatagctttgagttcatgtttaacctaacaaaattcagttgacttttatcaattataggaataatcaatctaagttctaataaacatttccaagtcagtaatgatgcaaattattaccctaaaccataaattcagtttctttagacacatggagtttgcctcaccctcagatgatgcattttggaagcaaaaccatttttattttaaaagtatatttataatttcaacttaataaaaagttttacataatatggtatatttgttatcataaatgaaccaattttgatacattaaagaataaatatgtagaagtatatttacagacatatacataccaattcgcatgttggaaatttagtttcaggtgcctgaattactcttctaatcctttataatgatgatggcacttagtaggacagaaattattatggaaattacaatatacatggcaatgcataattaatgccattgcattaaggcaggctttacagtgtctacagtgtcttgtaaataagtcatgcgttttagtgttctaagtgtatcacagtagtcttttcaaaaaccaaatttattcttatcctaaataattatttgtagtaatgccagtcctgctcccgtgccagaaaggaaacaattgacattttttcctctctttttttttcttcagcctgattaattgctgtacaactttaggataaagatttactttggccctggtttactggtgtggtttatgatatgcatggggaatactaaaatttaatatgtatctataaataattttgataaaaaaggaaacgtaacagccatggacacatttgttaaccagagtatgggcaaaaatgtcctaaagaattaaggaataaaatatgcttctagatgtgtaataaaatcattctagaaatcaacacattaacttcacttcattttatgttccattctgagaagatggtttctacaatttattatttattggctaaaactatattgcagttcttgaggtatacaattgataatataatgtcatcagatgatgaacttagaatatattatttctagtaacaaccaccaatttaatatactagccactaaaactaagatgataatgggcatttctgagctattatttccttttttcagtgtttaataaaacaaagaaaagctaccagatctataattggccctttactttttgcttgactgtctcaaataaattgcctttaggtctaaggggtttaaaagttccccaaggctttgaacttggcattaactccttagaaccttgaggtaatgttgctatatatagaagtattctctaagtttcagaatattatatacatgactaaaaaagggtgggctatagttcattgtagtgctagatagatagatagatagatagatagatagatagatagttgatagatagatagataatagatggatacagtggtagagaaaacataaaatttactattttgaccatttctaagtgaaaaattcagtggcactaaatgcattcacattgttgtgccaccatcaccactatccatttctagaattctttattttctgaaactggaactctgcactcatcaaccaatactttcccatatccttcttcacctatcccctcataaccaccactctatcttctgtctctatgaatttgaccattctaggtatttcatataaatgggatcatacagtatttgtccttttgtgtcttgcttacgtcacttagcataatctttccaggctcatccgtgttgtagcatcagagtttcgttttaaggctaaataatatcccattgtatgtatatcacatttttgtctattattattagacatttggattgtttccacttttggtagtgtttgcttatcttaacacatgtcaattttgcttgcctatcacagcacctagcacattgtaggccctcactatcttttgagtaagttaatgtgataaaaatgcagacatctttagccttttgcagttttgtccctaacatttattagttcatagaaaaacaaatgcctttcagaagaaagcatttttagaaaaaaacaaaacaaaacaaaacaaaacaaaacaaatacatctaccacaagctcattgtgtgatgctacttctgtgctattttgcatcctcttggctccacctctgccttcgctcactcttgtggcttccagttttgcacaggtttcaccagattcacacagatgcaaactgactgccacttaccacaggccgagcaacctacttttccagggcttctctgacatggtagtgcaagacacctgcagaaacccactcagcactcacttgtgcacaacttgaagttgtgagggaattaatgttaatgatcctgtgctcgttatggatcaatgggtaatagaagcaagtggatagtgttttgctctctcatctgctgggtggaaatatagtagcttcctgtttatagttactaagactctcattttttggtatcttgggatgcattgtagatggggaatgaaacacattgtattgtgctctagcataacatctttggaagaattccagaaattattgttgcatcaaagattcagaagatgcaggagacgttgtccacattatattcctgttcaaccaacttgtattttccctgaaaaaaagtagaacaaaactggatgagtcatggaagatgacagcaagctattataaacttaaccatatgttggccccaattgcaactattatgaatgagttgtatctaaactagaagaaatcaacacagcctttgacacttgatatgcagatactaatctagcaaatacgcttttttcctcaattctcattggtaagaaatatcaaaagctgtttgcttttaatagcgaatatacagcagtacacatttactccctcaccccagggccaaattaacacttctgccgtttgtcaaaatatagttggcagagatcttgattgtcttgacattcctcagaacatgaccctggtccactatatgaatgatatattatactagttggatttggtgactagaaagtggcaagtattagagataccctgataagaaaggtggcacccttaacagtctgtgtggaaatcttagctagatcacccagttaattggatataatttcgacttccacattattataggtgacagtattgctcaacttcctgctgtgttataacaaaagtccccattcctcaagtttccaataacatcctcctcacttattttaagtctttactggcagtcacttttagggccttcagtctgcttcaagcagcctctcaaagtacctttggcttttaccaacacactcatcatcgtccttccagctgctggcccctgcacactttcaatatgccattcccatgttttagatttttgggtatggcaacatacctattccagccaccataatctgtatcagttatctattgctgcataaaatattacctcaaaatttagcagcttataaccaataaatattcattatcccatagttgctttgcatcagaaattcaggtacagtttagccaggtggttctgactcagggtctatcatgagtttatggtcaaaatattggccagacctgcagtcctcttaagaattaactggtgccaaaagatctgcttccaagaagatcatgggtcactcacatggttgctggcaggaggtctcatttccttttcaaaacactgcttgagtatttccatgacatcatagatggcttcccccagactgaatgaaccaagagagggcaagtcagaagccacatatctttcataatctaaacttgtaagttatacacaaatattttggcaatatctcagtggttacacaggtcatctccatgcaatatcagagagcactataaaaaggcatgaacagcagaaagcagggaccattggaatcatcttggagactggctacataccacagcctctctgcatcctgacagcatcatacacggcacttggaaatattgccacagtctatttattggttgaagcaagctgctcagtcactgagatcatagtggcccagaagatttgatgtcataagatatatttcagatagataaaatggctatgaggagtctctggctacccctaatagaaaagtggcagcacagacacttaggatttgggagtaaggccatactttttgcaaaagagaattactcacatctaggagaagaaaagaaaagcatgatacacacacacacacacacacacacacacacgccacaaaatagatcctgacaagctattgggtcctagtagatattgcatgttggacactaactttttggctggagttgtctattctaagctagatataatgaagcccaccaaataaagtatttggtaagacatagctaaaatccaatgtacaacagaaacggagcattggggatcaggcccacacagaacaacaacaaaaaaagtaaattacataaacacattgcccagactcccatggcacctacttcttttacagagaggaccttcccttgactcatggctcataagggatttcttaataccagctaaaaaaataaaaacttcaggcttaataggcttagcataatattttggcgctacttgcaaatggacagctgcaacacagcagccccacttgttatggctctaaaggataatggtggaggggaatcctcccacgggacagagctgtgagcttatatttagtttttcactgtttaccaagggacaagtagcctaaaatacagacttacatggacctctaagcaatggcaaatggcttatctagttgattagaaatacagaagtctagataaattgcatatgagtgttcaatgaaagtggatccaaagggcagatctttgtggactgtgttaatgcccatcaggcagcatctgcattagaggcagaattgagtatctaggtagggaagaaattttgacctgtggatatcagctaacctcttgcttcagattggccattgtatcagggatgggtgctatgtatggacgcagtagttagtataagcttcttctcaccgaggctggtcaaactactacaattgctaaggaccaacctgtaagaagcagtcagccaatatcacacacttcctaacacaaatagaacagcaattcattcttagcaaaattgacacttacctgcatatgcatttgtcttctatggctacagtgccttctccagcatcataatcagaggacttgcagatgcctggtttcttggtcttgtattttatgtatgaataatattgctttattcaaaagaatatatcttatagtaaagggacatgacaagcagcaatgacaatgaaatccactggactttctacatactcattacccaaaagcagctcttctaatttgagtagtagtattgcctattagaggcttaagtcgaaaaataacagattgcatgattggagaaatgttttccaggatgagccaagccagtaagcaaaatatggtgctgtgccataagagccaagacatacgggttaaaactctcaggcgaagtaggattggccctctctccatcgttcccctgagtcacttcaggaatttgtgctgtccatacctacaatcttaaactctgctgaattggaggatgtagttctagagggaaaaacctatacttgcagacattgaactagccataatattgagggagagagtctgtgattcattggatttaatggtagaatggtagaataagaaaatcttagtggtgcaagggataaattatatcaggaaccgcctatgtgctacttcaagcaattttatgcagtgaggaacaggagtcaaagaagaaatgtttaatcattctattctctggactgacatttctgagacgcatttcataaatctcctcagaaggtcccacaaagtcataaccaggcacctatagcagtggacaattttattacatatgcttgcactggctttcccttgatttctccttctcttattcttttgtgccttagccctgctccatggaattacttctaaaataaactattgcatataaacctttgtctcaagttctacttttggggtaatccaggacaacatagcatgcttttaaatttattaagatgtcacttactattttttatcaaagttccctgagatagagtgaaaattgtgataggactcctttacctccaatatcttgtttatttgactcccttagcatcaagtcggactgttgaatatgtattctccaaaggtagctcacttttggacaattgtaatggaagatcggtagcctgaaatgggtaaaaagttttgtccatttcacatttttgagtgaaatgttatgcagttcttagtgctattctttgacaccaattttaagacaacctattttaaacactcacaaacatatgcatttactagatttgctagttgctaccttcaatccattctctaaagcagcctctgaagacttgtcatgtcttcaaatccattgagattatatgtttgttatgatcaacaatttctattcttatttcataaatactctgctgccaatcacatttatactgaaatcctatataactctcaagtttgctttctgttttttggttgtagtaattatttgggaagtggggtaaggaggaagtttatgttgttttgtagattggcagtgcaactgttcaaatagatctttttaaaattttaatagatattgaggctattagtaccacattttgttattttgaaatcaagattctaacactctcaaattcttctgagtttatgagcttgaaagggaaacattgatttaggaatctgttaacttgaagaagaattttctctaagaaattgtttttgcatccccttatttgcatgagactttactcaaaaattgggaacttttcattatagcaccataaactctctaactgaattgctcaaatacagtttatataactacttttttgggggtgtttaactgcatccaaagaaaccacagaaatatttgagtggttgatggctttatattttcttcagatttacagagattgaactactggacagagtaacaaaattaatcttgtttattttttatatctactgcttgatgtaaagatcaaatgagatcatataggtgaaaacacactgtactatataaatatgaaataaaacatagcaataaaatacaatatagcaatgtaatctagggatgtggtatttaatacacctcttattgacatgttttgaggctgtttgaaaggtacctttaaatcataagtatgtgcattcctggtaaaattgtctaactgtgtagaaaaaatagtcagaagtttgccttataacaaacttgtaataaacttctgatgcatttaacgtatttaaataaaataaatctataagaagattaaacttttaatacatgtgtacttattaatctctgtatttaaaaatatatttcagccttaaaactcaatgaaagaaatatactattgtgttagtgaaagtctgcatatcaaaaacagaaaatatacacaaaataacacaaaacactgatgggaaatacattttaatggtcagagaaaatgttagtatctcaaataaatatattgagaaaaaacatccatgagaatgctggaaaatatagaaaccaattaaataaataatttacaggagaggaaattattatgttaaaagtcatatgaaatgaagatttaactaaaataacagtggatttgggcatattcatcaaattaacaaaagaaaatattataataaccaatgctgatcaaggtgtagtgatagaatgtagatttctacatgtttctttgaaaaatcagttgggcaacatgtattttaaaaccttaaaattgtcaaatgctttgactcaggctttcactttagtggaatgtaacctaaggaagttgtcactgatacatgaagactttaaaatactgtcacatgaaaatgtgaatctttttgtgtaaaagaaaggcaattcacaactttatcacaaacattcctcatactattggtacttagcttatgggtcaggtagtgttatgagaggatatcgtatttttaaaatgaggaaaccagaacgcaaagaggttaagtaattctaaaggaatatttagtataatagatcctaaaaatagattattgtgtttagcattgtaaaatcagctatactagtcactgattcctcattcattttctcatcagatttaaacagcctgttctaattttgtacatgtaatttgacattcttatataatttcttattaaagtttaattactcattgaaggtgaaagctcagcttgacatctacagtgatctctccttatccaccaaactgatttgtcatttgagagttatgttttaaattaaaattaaattaaaactcaagtcaaagaagctaccaactctcctcttatttttcctttgaaagaaatttaaatctagtttagatgaaaaacattcaaaatttatttttgtatattcaaaaatctatacaaagggatctaccaggcagagcatatatttataattaaatcaattcaattagtataattttgaatgggacagtattctaggcattcagataccagtctatgggactattttaagacagacatttaagatcacatgtttgcttctacctatggcaataaaatcctttgaaatgaccaaacgagtataaaataagcaaaaagatgtttcgatgctgaaaaacagggaaggatattgtgaattcttcataagctttgatgtatttctggaaaccacaatacacaaaagaatgaaggtaaaggaattaaggtttttttttttttttagtcaaaggatgaaccctccaagaaaataagcacacaggatttctccaataggagctcagacttggaggaacagcaatctgcaaatattagaggctgagagaaatgtgctcaggaattgctggtggaaggccaaactggtacattttggtgggcacttttgcaatactacatgtatcaaaagcttgaaagtgtgcaaaagcctttcaccaaattatctgactgatgtatagcaatggaggttcattatagcattctttataatattggaaataatcaggaaagacctaaacatccagcgatagaacatcagttagaaaaatcatggtgaatcgatagaacaaagcactacgcaaacatagtatagatctaaatgtgaaaatatgaagaacaaaggagattaaataacagtatagaaggttcaatctgtgtgtgtgtgtgtgtgtgcgcgcgtgcgtgtggtgtatctgttgaaatggaattatagcacattatgaagtaaaaaagcaaattatagaacaattaattggtagcacaatccaaaatttcgttttaaataaatttatattttaattgcctagtagaaggacagcaaaatacgatgactaggattagttatctttagtttatggaatttataaggaatttttctttcctattatttgacagtaatttctaatctttttacagagatttggttgggtaaaaacaaatagaaattttgttttaattttgttaattgaaaattttaaaataagatgttctgtagcattcaagagacagaatttagtatattactaagctgtttatgtactccttgatcttagtaaagtaggacatgctgttccataaccaaatccagaaggggaaaacacactatctcatgtgaaggatgcaaacatatttagtcaaacaagaaactggctcatttgagagttttatagcaaacaagcacaaaaagtagttctcataatttctcatgctccttttatggtgtttatcttttataaggctctttggaacagttgctggccacctgtcaataatgtggccttttatagactcaaccttttattgttctcatgcccttgacatataaaaagtagtcttagagaagtcaatgttgaatatggtggggaaagagtaattttaaatttagacggctgtcttttgtagactgaaataaagagacagttttgaacgatatcaagaggataggcacattataaaatcctctttagcaggaataaaaataaattcattattttatcaacattttgttaaagttagtgcagaattatacttaaagcactagcctaaggaaaactaagccaagtagcattcatttaaagtttttattgcaattttgcataattttacattgattccaagtgaaaatatttgtattgtgagtctatcaattacacacaagttttgggcatataaaacagttgctttaatttccttttagtgaaataagacatccagtgtttctttctggatttacataaaatctgtcaagctaagtgttctgcacatgtttattgacccacattgtagaagtgctttgtatgatactgagtaaacaccatcctacaaatctgtatgcaggaatacattttcattcacagggggatattatccatagccttaaatggaaagctgcctgtcctttattttgctcaatcagattccaaattccttctaaataataatgaacaaaacaataaaagaagcaatttttgaaccaatgataattcttactgttcttttcaaaaaccaaacaccactccaccagattttctgctacccctacctcccactcttagtaatgtaggatgcagagctgaattttaacatttacacagaaacatttgctgcacactgtcacattgtaattggtagaggatttcatattttccttgatagagtttgcatattgtgttttcaaattgtactttaaaacatttgcaccccttgaaacatggtagttaattgggttaacaattctcagttttcaagaggatttttagatgtggtcccttttctattgaatgtggtcctttttctattcaatttggtctcttttcaatgtgtacttgtgtcaagactgcttggagggaagaagtagacagcccttcatcgtgtgtactgtggggaagatctgatctttcaaagggttggttaattggacacacatgcgatacccaaggtgcaatgaaaagataagggcagttaaagcctacaaggtggacgatgggtttatttattttattatattatattttattttattttattttaggttcaatcatgactatacttccacctctgctttcactggtgccttcatgcattttattgttttcctttagcctcagtagatctttttatatatctccatgaagttttctcaggatatgttatctgctggttctcaatgtaaatatacttggaataagataaatcccacaatgttatctgtgagtagctggttaataaaaatctgtgggaatattattgaaatgggaattggaatatatttatatttataacatatgcttttcttagttatctaagcaaactttagaaactcttgtgccttatctatatataatagtattcttgaattcaatctctttattcccgctggcactgacatcaaaaatataatgcctgggatattaagatctataaactaacttctctcctttctaaacaaaattattgaagcaatttatccaaaagtaagccattgaaattaaaaggcatgttcaaaccatggaatgtaacaggttattccattaaattagcagaactgcaaagcttttacaaatataattagctaattaagcatatgtaaaaggtatacacacacacgtatgtgatgttcctggtattcaatgaggaacatcaaagtaagaactatcttacttatataatgaattctgaatttgaaataacacttgtcaatatttctatatgtcaaatggtaattttaaattaagtgatcaaaaaactattttcactgactaaccaccctctgtagtgggatcaacattgtgaaaaatcaataaagaactaggtgattagaaatgttcttggttgagaaaatttagtttctcaaaactaaagaatgaagatatactcctcaacccctttagggagtgcatttttattttttataaagtgggaaaagaacatttgattcatggtgttataaataagatgccagtattattaaacttttatatgggctgttttcttttatttcttaaggcatttgtacatcttgagtagaaataaaatattatatttttatatgtagctgaaaatcattgcagaaatatatgcttttaactagctctgaagacaagagaatattctagtaagaaatactatagttgacacccgtgatcatctgaaatctgcctccaagacaatgctaatttcagaaaaacatcgtgcatatttagttatccaaaatatatgtaatattactacaacagataacatggagaaattagaggttctcaaggttacactgcggttctgattgtaattaaatatagatttgtatttttaagttatgtcactagtatctgcttgtgttttcaataactagataaaaatcaaaaatctctagataatcaatgatatactgcaatggcttaaaggaaaagcacattttgtctttatccacaattaattatgcaaatggcatctgttgaatcataaattgattggaagtattttcttgatttggtttctgattttattcattcattcaataaatattactgaacttgttctatgtgtactgtctaaaactgttgcaggcggcagacaagggcctgtcctcaaggggctatagagtcagtctaatgtgataaacagatattaaatatttgaaaaaattactgattctactaaccgaaagtgtgactaacatttaaacattacgtgagaaacatatatggtactctggaagtgtgtaaaaagggagctctccataatttgatgtcagtaaatgatgaatcattttcaaagcaaccatcttctacttttattttagaatgaacttagaagtaagccaagattttttgctaaaatttggtttgtaagagtttgatatcttcaccagtccttatcttgtctaaggtaattttcagacttaagagttgactagtgtagcatagttctgtttcatagttgttttagggaaaaaaagttattttcagtatgcgtgttttccttagcaataacatatagacttgaagtcaattcacattttgtgtactcagatttctataataaaacattaatttgtgttaattagtaaatcacatctattttattttatttattattattattttttttgagacggagtctcaatctgttgcccaggctggagtgcagtggtgccatctcggctcactgcaacctccacctcctgggttcacaccattctcctgcctcagcctcccgagtagctaggactacagcgcccgccaccacgcttggctaattttttgtatttttagtacagacagggtttcactgtgttagtcaggatggtctcgatctcctgaccttgtgatccgcccgcctcggcctcccaaagtgctgggattacaggcatgagccacagcgcccggcccaatcacaactattaataatagtgctgcctacctaaaaatgtacagttatgttttttaagtgacacccttataagtttgctataaaaaatcatttgtttacactctgaggataaaagactagtagcctcaatctgattagtcagtctaatttcataattaattttaaaaactggaaaaaaataatatatcaggaagttcaactaaattacatctgggatttagagtctgatttagtataagacacttatattttcaaattcagacttaatggcatatagtttactcttaatttgagagtctgatataaatatgtctttatatgttgtgttcagatggaaaataaggaccactgttttgttcaagcacagtggggatggggaataaatgccaaggatgtgtggaattaattagaaaattttatacatattactgggttctcattttgagaagtttcctaggttctgtggttcccaaagtgagtatttagaaaaatctttaagaaagtatcaccagatttgtgaatatatattttttctttggcaagttaaaaataagattaaaatattattaggtggattgcattttgacagatgcaacaaacccactggctttctcccataaagtttcaacattcatacttcaaggagactgtttcccagtctccttgagtattttatatcccttataagaatgttacatcactaataagcatgagcattttacatcccttataattttgtacatgcaaacttcataaaggaatgatacgggtatgccaactatgcaatatttactttcatgcaataatgattagttagcacaatatttacagcaagtctctattctatttacaactccataatgccatttgtaaggaaattctcaacaaactttaaacatctttctcattaagcaaaattaaatgtttagattaaatatgataggcacattctttatatttctttattcatatactagcaattgttatgtacagaagaaactaactgaggctaaagctctaatgtccaagagaaatcatacaactaaaagttggaactggaatctaaaatccagaatggttttgttattcattaaatatttgaactcagcaaatcactttcccttcttgtttcctgtttttctcatccgtagagcgaatccattgacctactttagcaggtttcaaatttccacagtagaaacctcttgcagacataatcttatgcataatccccatgtgaataaaactaataatacaaatagagtttttcttataaaagcatcaatcagggaggacgacagtagtgtaagggtgtgaggggcactagagcccaccccacatgttggccctcaccttcccacacaacagatggaaaatggctttaaggcacatcaaacaatttctcaaattcatggaatactttttgaaaatcatgtacttacatgaactttaagtttctttatgattccaaaataatacaattctcaatttcgtaaattgggatctgtctattaaagtactgaaaatcatatcatctaccttagaaaaaaataatatatgtgaatataaagtttattctaagaaggatttcacagaaaaaaacccatatttcatattaaagccactgatttaagtatcacatcaaacagctctgtaataccaaatagttcatgtttaagaaatgaataaataaataagaccccaaataacctctcaatgattagaaaattgcaaaagtcttttagttacatttaaattcccttacccagctctatacttcacttgggaaatgggggggaaatttggtaaatttaaaggcagaatgtgtgtaaatgaagatttttgcttcttagttttgataaccagagagtgaacactttaagctctagtggcacacatgatatacaactattagacccttgcagtcatagtctatgaaaataaaatatgttgaagaagagagcaagttccacaaaatagttaactgtccaggaagagaaatgcctgcaggagaagttcttcacacggggccattttctttgccagttactgaaatggatttgatgattgtgaggccggagtaatgagttttcactgtgactaatttctgatgtcctttatcagcaaggatttctaactacctaaaacaaaggaaatgaacaaaaccaaacttttcgtaatccctaaaggacccaaagtgaaattgtcccagaagttaccttatatagactctgtgacacagttccccttttgcaaaaatacttagcgaggatcattactttccaacagtcgtgtccagagacctactttgtaacaccgcagggaagttaatgtactaggtcttgaaaggtctttctggaatgtgcagtaacttgtagttttcttctagtagcactgctaatttttgtgttataatttttgtaggtccatggggccgatgtatgggagatgaatgtggtcccggaggcatccaaacgagggctgtgtggtgtgctcatgtggagggatggactacactgcatactaactgtaagcaggccgagagacccaataaccagcagaattgtttcaaagtttgcgattggcacaaagagttgtacgactggagactgggaccttggaatcagtgtcagcccgtgatttcaaaaagcctagagaaacctcttgagtgcattaagggggaagaaggtattcaggtgagggagatagcgtgcatccagaaagacaaagacattcctgcggaggatatcatctgtgagtactttgagcccaagcctctcctggagcaggcttgcctcattccttgccagcaagattgcatcgtgtctgaattttctgcctggtccgaatgctccaagacctgcggcagcgggctccagcaccggacgcgtcatgtggtggcgcccccgcagttcggaggctctggctgtccaaacctgacggagttccaggtgtgccaatccagtccatgcgaggccgaggagctcaggtacagcctgcatgtggggccctggagcacctgctcaatgccccactcccgacaagtaagacaagcaaggagacgcgggaagaataaagaacgggaaaaggaccgcagcaaaggagtaaaggatccagaagcccgcgagcttattaagaaaaagagaaacagaaacaggcagaacagacaagagaacaaatattgggacatccagattggatatcagaccagagaggttatgtgcattaacaagacggggaaagctgctgatttaaggtaacattttaattactgttaactacacaggcttgtctgtcaagaatcatgagtacctaagatatccggtactatctaataacttctggattacgtaggggcacaacctaggatgagctacccccaaatttaaggcttctgagcttgtgtgagtttctcggtgttgtttctattgtgtccacatttaggccctgtattacttgagttattttgattttcctttcaaagtctggagcatgagcaattcttcatgaaaagatactgcttcttctctatgtgtagacagtgtcgtttccctataatagaaaaaaaaattgcttaggggctgaaatattgggattttaaattcagatacttattttagtgagctaatagaaaaaggcatagttgtaatctctccaagacagcattttcagaattaccctataaacaaaatctgctctaaacaacaacccagggagctatacctaagaataattttcttgcacattgtatataatggaataactccctccagagaaggaaacagcaaccagccaaaaataaggtaagtagagggtattgaatcatgagtagcctcattcaggaaacatgtaactaattagcttcattttctagacagaaattatttaacaaattatctttgggtacataatgactatattatgaaaaactatctcatgtatgatttacttattgtgaaaataattttcattgaggattatctgaaagacatgatgttctctgggtattttgaattttgctcttggataaaccagaccatctgggagtggcttatctggatatttgcataattgctttttcagaaatatttatgcagttatgatttggattgaactgaaaaaaatatagtaacatcagtaagaattgtatatcagatttactgtagaaatgatattgaaagtgtcatcaactctatcacacagtctattctcttgattaaaaaacatataagacaaatttccctgaagtttcgacctctgcgcttctggtgaacagctggattgtttttcttatggcctctggaaatcttgtaacagaccacatttgcatgttaacttcttctgttaagaacctaaataggactgtgtggcatgcatgttgtttattaacatatctttagctttatttagctttattttttttctcacctgatttttttttcaatctattcttgtctactgattttgctatgcatagattttgaaatctggtttaaagtgtttttggaaaaggatatagtttaattagataaacaaaaattgattggtctgtctaagacaataactttctctcatcatagagttctggttactgttttttggaatttttgctactctctcccctctttgtattgacacgattgcattttatttcagctgtacggtaatttgccctttttccattctagttctggtcctgtggccttgaatgaaggctgttgttctgccttcattctccaggtttcctacaactccttaaatgtgtgtgtgtgtatgtgtgtgtgtgtgtgtgtacctctgattctgtatcatgtatattttcaactcaattcctattttgttcttttctgactatccttattctggtgattttcttatctcttttcctgaagtatattacagttatattagttacttggctgacatcaaataattgaatgagtctccaagacaagttgagttgtttcctgctatcactgggttagcatgctgtagacatttaatttaacgttgactactcaattaaaagtgtaattaggttagtagctaccattgcatagagcctaatattctcatccagttgtttgaattaaacaaacatatttaaaactgcagagtttatttgtcaggaacttgtatcccattagaaatagcatatataacttccaataaattgatagttgcatatattttctgacttattacagtataggttaaactttatgttaaatatattggctgtgaatatttctattatatatgaattatcatgtgtgatcaagaaagtcctagagaagaagagataaaaatcagatattttgacctacgttttgctcagatattataccatgatatcagtgaagccaataaagtgaagagtgaatcaatgacatcaccaaagcacagggccacaaatcaagaacttagtgatcaaatttaaaatgttttagcttctattaaatccagaaacaattttaccatgtaggagaataaaaataatttaatatggctaaaaattacattatagtaactgcataagtttaactaaataaaaccaagaatctggggaggcagatcatagacaaaaataattttagaattactgctcaaatgtttaagttaacaatgatggatctgccctgctttccactttccaatagaccaaaatcaataagaatgaaaaacacaaatgaaactctattctgacagcaggaaacggttacagtcccaaaccacagttgatacagaaatttggctaatgtggtaaaattagacacaacttagggaggacacttagaagggcattatgtgttacagctttcatgaacactcagaatctctaagagtagcctgaactttctgaggggacaagccaatgacacttccttagcatgacatggtctgtgtcaatgaaaagggctgctgaagcatacttgagttctgcttgaaatcagaatagcataataggcaggaagcccactatgctattattgccaacaaaagactatcagtttgacagactgagggattaaagttttgacaactagtggaagagaattctaaatcactacacatacactaggacacaggaagcttccctgtaaaccagtgacttccagccaggctgggtgaaatcttagcaggaccaagagatggtatgaaagtataccaggtgtttctccaagaaaccaaagatgttaaaggaaatatggttttctgaatccaaaacagaaagaatttaaaaacagaatgagtttaaaagtgatctgttagagctcaaaaaagaaatggaggagatttataaaataagaacagaaatgcaattcacattagaagcaataaaaaatggaaaaatatttggtggtgaaaagagtcaatgacatagagaacagtttgagaacatcaaataaactaatttttaaaagagataatggatatgcaaacaaaggacattactatatgaaacgctgatgttcctgaagatagaaccagaaaaattaaaacagaaaacacaacaaaatacaaggataagactttcctgaaattaaaagaagaccttgattcacacatcgaaattgtacaagactaatattctgcaagaagaagttgaaataatgacctaatgggagaactaatatagatcaacttttatggagagagataggtgaagagacatcagactgaaagctgggacggtgctcaactgtgaaacattagaagcattctctttaaagtaaaaaataagacaggacagcagattatctgtaatgataagaccttttcattctaagtaccagtcaatgtacctgaaaagagaaggaaatgaaaattagaaagcaagtggtaaaaataagaccttttccctcagatgttacgataattctggaatactccagctaatcaattgaaaatataaacaataaaaaaatcaataaggttgatgtacacaaatataatatccaaaaatcaatatattccctagatgcttaaaaaattaaatattataatggggaaaaagattaaaatatctcatttgcaaaaggaaaacttaaaacaaatatgtaaatatgcttaactataaaagttctgcacttaacactagacttggaaaaatagaaaaggatgtagttgtgcttgtctagaatatttagtaaatataccaactgtacattgttactgtgaaatttataagggaaaaatagatgtattagacaggaaaatactgaaaaataaagagagaggaaaggctaacttcacaagataattaagtgcattatactctatggtaataacgataacaagtaatataataaattatatttatacaaacagattaggcacagccactcatcatttacagaaattttatatcaatgtaaggaactgtttaccaattaagttcccagatcccagccaagggcaaaccctccaagcaggcctttttaaggatagaagtctcagcctgcagtactaactcttatgagtgttaaataaaatttacaggaggccattggtcaggattgagcctcctcctcctgcaccaggcccaacagaccaaaccaaaatggtgttgcttatctaaaagttccagtcaccaaactgaaaataagttctttatctgccttctgagaaatcaggggagagagaggtaatagccaaatccccaaacaggccaatcctagcagacacgataaggattttttgtttgtttttgtgtttgtttttttttctgctgtaacctttacagaaaagtaactttgaaatgaccaatccacgttttgttttctgttttgctttcctcagccctttactatctataaaatcaacctcctctgctcagctcatgggaatatttattccaacttgtggaatgaagtgttgccaaattccagaattgcagataaaacctattaacatatttaaatttgttatgatttttttcgtttgacatagacaaaatcatgcagttattaccacataaggtatgtgatttggaattaaacatgaggaagtaaaggcaattttactccactcccctgccttgaaatcacccagtaaccccaatcaaggaaataatctacagtttaaaaacaaaaaaaggaaaatggaaaactgaaaaaacgaagtgtctatatgataaatctgtgcctcagagacggaggaagctagaacctgaagcatgaaagagactcctctaaagcacccagtggcacaatccataaaggtttatccaaggctcttcttattggattatcccaatctggtggggggaagggcaagacacagggaatctggggaaggtcccttaagagccagttccccaccccagaatcacagaagtgtagctgttggggaaattaagcagaaatgttattttctggtcttctggctgaggtaagctgtcaaaggtagaatggaggaggagtagggagaggaggcagccatctccagactgcaacaagcatagcctgtgattgccattgcatcctcacctctggaatgctctacctgatgcagctcaccttctcctcaaatgaagaaccaaatctgcgtattgaagagcaaggaacaaggatgaaatctgctctaagtaatactagaaacatttaatggatgtagtgcctacttttgaaaatatcttccatttgaacctatctcgttttgtcgaattgtctgacaagggcaattaatggtaattataattccaggagaagcatttccaaaaagtgtgggaaattcagcccagtgaattcctgagggaataagacagatttaggattttaaacagatttctgttggctaagccaagaaaagtagaactatccagcttctagataactccataaagcagatacttcaggcacaaatacatgggataaacataactgggtaaaacatgaaggggtgaatattataataacctctagaaatattaacatcttggagtatttttatctcatttctgttaccaaattcatttttcattttaagtctttatataaattcagccttagcatttcagagagtaatgaataatacttcttaaagtggatttctgatttttgttttccaggcccagactttctggcatcccctctcatcttcaaatttaaaactgttgagcagaaaattgtattttttctcaacacagcttatctctttttgcctggttcttattttaccttagaatactagttgttaattactccaaacttctgttttaggattgctttccagaatggtgatatcaaacttgaatataaagcatttgctttataacagttgtgaagctggctgaatcaacaagaatggaatttcagtaatggataattgggataaataaataataaataagaatagtaaacctatgcattcatggctacagagtattgaacaagtcatttacactttctgggacccagctttctcatctgtaaaccatacgtgttctgggataggcaatgatgaggtagagagggagagagcctaaaaataaatctctaaaagcctttcaacttttgtgattctaatgaaccccaaacaaacaccatacctaaaattgcagacataaaatcctatatatctttcttggcagagagttaattaattttcaacatggcctacagatcagttcatactgaaacatcagggtgaatttctatgcagtgcctatagactaaggcagctctccgcagtcttgggagtaactgcaaggttatcactcagttgatgagctatatggttcctgagggcccatccccacgctacgactttgtgaatcagtaaaattgcaaatctaatcctaaccttaccaaagagaaaggagaaaattgcccactatttaaagtaacactccttttaggttgttcagaatccatttataaaattactacttctaaatagcaggcttttagatcttaaaactttctgttatatccaaagcgtcgagttgcccgccagatactcatcatcacgtctcgcaagcttgcctcggctgcctgttggccacacctgactaaacagagtcagtatgcccatattctttggtagatggtagatggctaaaaaggacattttagttttctcaaaatgtcgagctgaccaggcagtatattatgtttgaccttagaggtccactatcacctcttccccatcctgctcgtgtgtctggatgctgacctctgagcagtgtattcataggcttctgagccttctttctcattggattctaccaatgggagaaagcagcagtatatcagatggtgggaagagagactattcctgtctgttcctggctgaatttctctagcaaaggctcctgcctgtatccagcagtcctctccccagctctaggtctacctcagattctagtaaaatcctttcccttgattcctttatcgccatagggtaataatcttcctatagttaatagctgcaagatgctataccactcctcgatgcctacaattttgttaataatccttttacgaacttttctgaattaacccctgtgagtttacattgttttctgctggccctgattgagaaataatagctatgttaaagtacggtgtcagaaccagagaactgcttctatgtcattgttagtttactcattaactaattaattcactatgcatttatttacttatttaccttttcattcaacaaaactaaaggcatcaagacattctgggcactagaatattcagacaaaaagacaaaacaaagatcataatctcaaggatctacattttattatagaaataatgtcacaaaagaaacaataaaatattagaggtgctatgttttgtctacagagagagagagagaaagtgcgtgcagataacaacagagataatgagttcttcctggaaggaggttggcaggatcaagaatggcctcctagagaaaatgctgctagcgttaaggattagaaggcatgcaccaggtctaggatggagatggccaaagaatatgggaacaaaaagagcaaaggcactgagaattgcagcagtaattgttccgtgtggaaaaatactgtttctgtaggttgtttcacctctggaggttagattacaaagggaagaggaactagcctagaagagaaatggagaaaacctataaaggtcttggaaacctataaagatcttggaggtcaagtttaaatgtttagactttatatcctgcaggtctaaacatttccacatttattagtaacagggtttttaacacgccccaatgtatgtttatttatttataagttatatacatttgctattataaaagtatattgcatacattttaaaatcacaataattaaaactttaacataaataaataaggaaataatattttgccaatcactatggctttatgttatctttagctaggattgtaaggcaaattattcatgaggaggtgcattattaatgatagtgattttagcttattttatatacagtattttattttttatataaaaaataaactatctttttccaatcagttaaaggggagcgcatacattttcttactcctaccaaaggtatttatatttatttcaaaatgatagagcaactaggcagtcagaacatattcttcactaaaccagcactgagacccaagacagctggtctgaccaaaattataattcaaaaataacttgacttctattttgttaaattcccattgaacatccctcattaactatgacatctttatcttcaaacttatgcttcagtttatgtacatctcccattctgatctgttcacctgttattatcaaaatttgtttctatttacttctgctcttttcctcaacttaatttcattccttaaaaaagtactttgcatttatattatgtcaggtccaagatttcatgaaaaattgttaaatattgaaggttttctcaggaaatgtgtgttatattatgaaaggctatataccaacacatatatatttatatgtatacattttgtatgtatatatttatatgtaggtatattatgtaaggctatataccaacacatatatatttatatgtatgaatttataatctatgtaataacaataggtgaatgactagacaaactttctttttttaagtaaatatgatttttatttaattttttttattttactttaagttctgggttacatgtgcagagcatgcaggtttgttacacaggtttacatgtgccatggtggtttgctgcacctatcaacccatctaagaaagatgcaacgttaaccttaatcgcttacattaggctaagacaatgcctagaacataatcagctcccagtaaatgtttgttacagtattaaaatttaagaaaatcttttagttttaaaacctgagtcttttagtaactaacaggaattcaactgaagccaatgagaaaatggaaccttctaaggtcatgacaaaaaataaccagaacatgtaaaagaatatcctcaaaagatatgttttattcaattaagataatatacatttatactgattccatttaggatacaacattgagaatattatttcaatattattgttcctggttaacactaaataattgctgttgttatattttctttataaatgagaaaatataccattattaatatcataaatgtattccaatagtctctgagaatttttaaatttagtgtcatcttttgtccatttataagtgtccttacttatatcagtcactcctgtttttatatcttcaagccacaaagctcatcactatcaattagttggtgtcagtgatggcaaattaagggctaaaattgtcaatgtctacctgtaaacttctaacaaattcaaaaatattaaagtgaccaccagggtcacttcttacatcccagcgtatgattatctcatcatggacaggatgtcttcacctctccttttacttttcaggagtatttttaaaatcacattattggggtatgcttgatatatgaaaagttgtacatattaaaggcatacaactcaaggaatttgggaatatgaccttgatgaaaatgatcaaggtcataaacatattcatcacctgcaaagatttctttctgctccttttattattattgcataattactattatttttattattttgtgttgtaagaacacctaacataagacctaccgtcttaggaaaattgaggtagacaatgcactgttggttatttttgttttaagtgaggaaaattaaataaaaagagggtcctaggtagtattttaaacctttgatggatttggggaagggactaaacttaagtcagataatatatgtcactgcctaatcatcctccacatgaacttgaaataaggtttatatcactttcatcacttttcctgggagttttagtaatatctcccatttagttgttctatttagctctcttgcttgagacattgtgagagcaagtttcctatgggagccttgctgctgatcggggcagtgaccttgcatttccttggcagcaactgtgatcttacccattgttttcatttatttgctggaattctactggcttgatgtgggtagtattgagtttcgctctgactcaaacaagaatagttttaaataggaggaaatactttcaaaagaaaatacaaattcccataaaagagggaatttaataaatcattaatgcattgtttgtttgtataacctaattaagaatatgctcactcttttagagtctgctaacacattatattagtaattccatgtgttttatcttattttcttctttttaggcctctactcacactttcaccttgctatgttctttattttttttaaaatctcatatcattgtattataaagggattatctagctttttcccaaaagtttcattgagagatgctttcttctctacttagtacaaatatgtggtcactgatattagataaaagatgtgatgatgaaaaatttgtttgagtagtatttaccagtatagtaattgaattgtaagtggacaaaatactgctgtgcttaatacaagaagccattgtacagtaaacatcttggaatattgacacaagcacttacaatgtaacatactggaataaatgaagcaagtttttgaaaaataaaaattaattatgactaaggttgagactatgcaacaataacaacaacaaaatcattttaagatttcaaaagactacatataacagatcacaaactaacctacataaatatgaatatacatatattcccattaacagatgggtaagaatggagacagatactgaaacagagatgtacatcctaactctggaataataaatatgaatttctcagaaattattttcagtggtataaaattggaatacatttgaattttatacaatatacgatatactgatacattttggtttgtaaaatggtgttcaaatgcttttatcaaaaatatacttctctggcattctaatctatcaaggatcccatataataaaattaaatacaaaataggtgaaggagaacatagtagtcactacctagttccaattctgtataaagccttatccctaactttgatgtctttaattctgtttaggaaagacaagagaaaaacaaataaataaaattactttaaattactgtaattctgggttggcccagagattttgtatcttttatgggttgcataatgtagagttcatacttggtaaaaaataaatcattgatgaaaggataaatcttacataaaaacaactaaagtttttgagagaaggactgtacctatatttattaaggtaatttgataaggcagtagaatttgaccagttcctccccagaaatgtatagaacttacctaagtagggtatggtggaaagactgagcattccaagtcaaacctcatttttaaaaaatctgagaagtcgaatgagcaggttatctgtaaggggcagtcaagatgctggtatgacttgaattaaaggagcaggtggcaaaagagcagtaaataacttttgaaaagaagcctaatgaccttgatggtaaggcagaaaaatctggccttttcttcagtaaactgaggcaaaattatgttcataaacaggaatgatatgcagaatggattggaggggtcaaattctagagtttggacagccacaagtaaggtcgtggttataatccaagaatggggtgaggaagccctggatcaaagtagcagcaatggaggcattgagaccacatagacaatacaggatcaactcaagtggaaattcaatattggcagttttcatttaaaagtttgattgtatcttctgatgtctgcctataaccagcctccaacctttggagttctgatagataaataaatggcaaaatgctgggatgatttggatagtgctggcaaatactagaaacagaaggaaaagaagttgcctgccctattttgtttctatgttatttcatctttctcaaataatatgtatcaaataattggtcattttatttggagtcccacgtcctcaatagacgaaagtcagggaaactctgagatgatttcaggtggccagaacactaaagctgatcccaggctctgtttgttctaacctttcatgatactaacaactgaggttctcttctattccttgttcaacctagacacatgttttcactgtttatccttgtatgtgctagccaaactctacatgttctaggtttgaccctgccgaagagggagagatgagtgagaaaggatatttttaaataatcacttcgctctactcacccccacccccacatttacttactttctctaatcctgaactgcaatagaagaggaagtcagccatggggtgtggcatagcattcttttcttttataatagatgatgaatcaggaagtctgccctgagagtgtggcatggcaattttttcttttagatgatgaataaggaaggaggacttctaatcaaggaataatatggattagtgggggtgggaacagggtaagacgcaagagatgctactgagacacaaaatttaatgaggcactcacccccagggtcatgcaagtgcgttcttaaattttgttcctaggtacttccttgcttttcctagttccgccctaagtgggaagaggagtgagctgactcatggactgaggaatctcatgttctctccctgcaaagacttcctcatctgtttctgtatatttattcagcaaatatttagtgatcatctatcaggtgcttaatttttctttcctgagtcctaatagcactgacctggatgatagctaccttctaatttagatagtccatgaatgtagcaatattttaggcaagtataaagcactgaaggataaattttgaccaggttacaaaatcatgaattactttttctttgagtgtaaacatctccccttgtgggaaaatatttaagccttcaactctctgcctttattttctcccacaactatgaagatatctctaaagcctttctaagggatacctatgttataacattttggagattttatttagccaaaacttaacttggctcttactttgttcctctatgcttactggttatttaaaaaaataattcatataatctattcatgacattaatacatggcccttcactatgttattttagaaattaatattgagtgggacaattttagatattcagccaggttgataagagagaataaggcaagtgaaaccctggtggtcctgtttaagatagagcttttaggtagtctggagaggtagtgtacctatctgccgggagcttagaaactaagtcatatttgacactagaagaatcgttttacacaactgatatgacataacaccagcatcagattcagatggcctggattaaagtcagaactttacaacttatttcttaattttaaagtaggtataaaatccctgctttacctatgtgtcaggattattgtaaagatacaaaaaaatcatgaatgtaaaattgccatgtaatttgataatggctgaggaaaacatgaattttattaataataataaataatggccttaaaataattagatggtaaagataattgaaaacaaaagagaaaacaaagttcttaccttcttaagttttttaaatctctttcaaaaaagatggggttatattgaataatgaggaaaaatctatatgtgatgtatgtacaatttggaaaattaaaataaacaccatttttaggtatatgtacctttaaaatgttaagacaagaccaatattaaaaagataaatgtttactttgtaaatatatacattttactttaatatgtctttccattaacattacaaaatcttttcctactcacactagccagaaaaactgctttaaattctggaagcatccaaatatcactaatatgacgttatctttaatacatcctactaagcacaaaataagactgtccttatgtagaagccatgtcattatgacaaacatatttgaaaattagttttgtatgatttgtgacattcaacaaatctgatacaaatctgcaacagccaggccattgagtattttgatcttcaaataaatcatggagctttccttggagaaaaaattactgcatcactggtttccattacaaaacaatttatgaatgcagaattttataattatttttatccttaattattaataatttatatcctaactagtaagacacggaattcaaaattacagtagataggaagattctttatgcttttctttctttaagtgccaaggatttatgtctatttgtgtctacaggaactctatgacaaagactaaactctgtgacttagttcagaataatgtgaggttttctatataataaaaaagataaatcagagaaaaaaagtaaggtaaaccaaatctgcaatttaaaataaaatatgaaaatgaggattgtgttggaaattctggagaaatagttattaaagggatgtcatcgtaaactcatataaagtttatatcttgccagaaagaaagcaaaaggtagaaagtaactgaaagaaattaaaatcaatagaaactagtttaaactgatgatatgtcgtgactgggatacagtgtcatgatttggaaacgcagtattgagtgaaacgtataatggattatgtcatgtaaggttaattttgacaactgtaaatcagactaggaaacactgtgaaatcgtcatgaatgatgcatgttctctgctgtgtcatcttaattttagacttgcaaatttgatttctgaaactgcatttgaacaaccaaagcaatgtgttgtgaaacagatcaatttgaaaagaaaacattgcctaatgtgagttgtgaggtttcttggtaaaagtgcactggtgacatatctatgcaaagtttcattttacctcccatttcattatgaggctggtagtctagagccgagggagccagaggaacacgtgaagctgagaataaattgggagtgagggcagttgtcctatattgttgctatggatagagctgaatagtccatagtgagcttttattgtctatcggggacatttactgagagtgcctgatggaaaagtacagattgaatgaaaacaggctagttctaccctgttgggggcaaatgaagtgcttcggttgtgctagattaatttgattgtgataataagcatgtgttttttcatatcattcatgtgtaggattttgttaactagaccatgaactacttgaaagtgtctttctgattcccctaccctttcctcctctgtctctgttgagaggactgtgaggagctgctcagccattggaggttaccaaaggatgagaagggtgttgtcattcaatatccagaaaatacagcctgtgaaaccatacccattgttctgcattggtcttctctattataaatgatcatgttgataatgtctttttttaaagttggaatttcagttatgtctttatacttgtaatcccctcacaggctttgtatttattatttcattagtgaaaaatgaatgatacttcttctacatgtaattaaatttatctacaaaagtaactgcaatgccacaggtgtatcagtaatttttaaagtgtttgtgaaatttttctagaaatgtttttaaatgcaagatagatttaaagaaaatactttagacttacaaaaaatgctttaaaaatattaagagacaaatttacttcaatgaaagaaaataattgttgaacattcaaggaaattacaatttagggcatttgtagaggaggaaagatgtgaagtaagaataaaattattaattacttaactagttttattgagacagttcatcacattattgatcacgtttgtcaaccccatggtttatcattgccaacttattctttttatctgagagaagtagactagatgctaaggaaattctagaccaaactagagccttcttctatgttaaagatgaacagcaccttatagagacatgttttatcaggaatttttaagaaaggacaataaaataattataaaattgacatattattctagagaggcatcagagttaaataccaattataaagataaaattataaatatttaaactgatttagatagcaggaatacttgatatttatatttctttctacctttcttcatattgtctatcattttaaaagtatgtaaattgggcgggttgcagtggtttatgcctgtaatcccagcactttgggaggctgaggcagtagaatcgcttgacaccaagagttgaagacgagcctggacaagatactgaggcctctatctctacagaaaataataataaaatttaaaaaattagttgggcataggagcacatgcctgtagtcctagctactccagaggctttggcaggaggatttcttgagcctggggtttggaggctgcagtgaactatgattccaccgcaggagtccagcctggggaacagagcaggatgcagtctcttaaagcaaaaaaaaaaaaaaaaagtacagtaagaaaagaaattactgtttattcatgtggctattttaatgtaaaagtttagataaaatacataaatcatatcaagatttatcttggaaacctagttgttcatgcttagataaagacaaagatcatagttaaatcacatctgggcatttcttgtagtcattgatatacaaaatcacattaacatttatatctgaaagctttgaaaatccagtgtattttagtaacaaatgtaaccagtttctttatatttcttatttgctgataattctttatctttgtgtcctctaggttagatataaatattgcctaatataatgatgtttaaaaaagtttttaaacattgcgtactctttatacacaatggaaatagacttttttaattatttaaattttatgtattactatctttattatctttggattgagaacgattcattaaaatataaagaaaaaataaaagccacctaaaatcttaccactctgaaccctattaacatttaggtgattatgcattacattatatatctaaattcatatgtgtgcataaattggattgtatattaatactaaatttattcttctccttcttttttttttttctttttgagtcagagtctcgctctgtctcccaggctcctgtgcagtgttggcgcgatctctgctcactgcaagctccgcctcccgggttcacgccattctgctgcctcagcgtcccaagtagctgggactacaggcgcccggctaatttttttgtatttttagtagagacggggtttcacctgtgttagccagtgtcttggtctcctgacctcgtgatccgcccgcctcggcctcccaagatgctgggattgcagtcatgagccaccgcgccccgccctattcttctccttcttacatcatattaaaacatcaagcacatcctcattccccaatggagtgtaagttatgttaataaggtgtattcatatcaacctacacatactgattttacacatacacacaatttatcttgctcatttttagaaaatgatttctattatataaaatatacatcttacgtgtatatacaatatgtgtgtatacaatatgcatgtgtatacaatatacatctgcatcttatttttgactaaataaaaccctgtagaaacccctccaagttatacagaatagctctaatccattcttcttaaattctttattgttggacattaattttatttctgttttatgattaccatgatcaagcccacaataaatagccacatataagtgtccatatgaattggcattttaatttctgtaggacatattcctaggtgtgggaattactgggtcaaatttatttttaaaagatatttctagatgctttcacaaaaggtggtaacacttgacattttcttttttttattgttatactttaagttctagggtacatgtgcaaaacgtgcaggtttgttacatatgtatacatgtgccatgttggtgtgctgcacccattaacttgtcatttacattaggtatatatcctagtgctatccctccctcctctccctaccccacgacaggccccagtgtgtgttgttccccttcctgtgtccaagtgttctcattgttcaattcccgcctatagtccttgtgatagattgctcagaatgatggtttccagcttcatccatgtccctacaaagacattaacatctaatattaacatctaataaaaggtaaatctaacgtaacaacaaaggaatagatgattgttgataacctgtgtaagtagaatgctagagtgtgaagtattagtgttatttgccaacaataaaatattagaaatatatttatctatcctaggtctccgttagcattcatgtaatatagttaaaatttctgtacttccaataagaatttgtaggtaatttacaacaataaagctgaatgaatgaaagagtgaatgaatgaatcatacatacatacatacaaatatacgtgcaattagtaagatgagaggaaggaagatatatgaagttttaggagcacttttgcaagagggctatagtaattgaaaacaaaagttagattgatatacctgagcagcaaatagaaaatatgaaagatgatttgtctttaaaatgtgtatgcatgtgtgtatgttatgcatgtattgtacttttcctgtcagtttctgatgaatgttgagaacataagcttatataatagttccggtaaaacaattcaagaggggccaaagtactatggaccaaccaaataaaatgttacttttggtttgaggaagtcttagttcctagactattatgctcagatatatttgtgtatacaacttacagctattttgcaatgcacaaatatagcatcactgtgatatgtttttaaatattgcttatactctttattcacaagttttcttctgtttatccttgaataataagatgataattacatttttaaaataaaaacatttaaatgaatgattctgtacacaataaaatcaaaaacttgtgaggattaacagcctcacagttacgatttagtaattttccctgctctttttgctatttatcactttttttctgagtagaataaggggaaaagctacaggatgtgccctttcaagaaaaacaattaaagcaacaaaagagctagacttctcaaaagtcactgggttatggtaaaagaagacactggggagagctaaggaagggctgggcaacgtgagaacaggagaacacaaggaaccaagaagaaagggaactacttcctggcacttaagtgagtaagagaaaactagcaatttagtcagtgctgctaggaagcagattttcaattttagctatgcttttatatattaaattattcttggactgtgtaaagcaatacactgcaaaaaatttctttctgccactctaaatagttttggatcaaaattgtcagaccttattgctgttacaggatatgtactttaatctgttattggtgttcaaacctgtgtcctcttaacttgattttgttgtatgtccaacacaggaagaggtcaaagatgaagtcagcaccacagtctgaatgaaattttaggtgcattttgtgataatgggtcttcctcctggaagcagagagattgagaaccataacaactttatgaagaaaggagtagcaaatgagtcaaatatcacagagacattaataatgttgaaaatttgcctacactggtatagaggtgtatataaaaattaagggattagaaaatattatctatttaaaactttagtatataacaaaggaaatatcacaaaccagtaaataaaggaaaaattattcaataaatagcactatgacattagtaatatataaaaatttggtgacataattgtttttaaaaattactttagaatcttactctgtacacagtaaaacaaaatgaataccagtgagatattttttaaatgttacataatggaagaaaatagaagacataaataaatattatctaaatctgagtgtgtttccttcattaaaacaagacaatagaggaaattaaagaaggcaaaatcatataatgtcagataaaatacacagtgtgagaccaggaaaatctggattaaatcaatgttcctccacttatttcagacagatgacattgactacaattgcacattgtcattggaaattggcaattaaaagaaaaggttgtgctcttgtactatagaagggattgagcaaaaaagctgaccaccacttataaataatataaaatgagtacactatatatccaaatatatagtgtagaatttagccaaagcagtaattatagacataggtgaattcattagaaaactagtatattggttagttttcttagctgcaagcaatagaatgcacaacagctagtttaaagtaggaaggggtttattactgaggataggcagagtgcagaattcctgggggagtcaaggaaacaagtgtggatgccacttagccagaagaaatacaactgggataattgcccagctccacgaggagacagctccagcagaggtcatatgcctctgctcaccactgactgttcaatatctttagaaccagaagctgcactctatctggtgaagaatagccatgtacctctgtggctgcttgtcttcaagtcagggtgatcatgtcccttggttgcatacagttgtgtttacatcccttccaagatgcacgcagttgcatacaccttatgaagcttaggccacatgtggaactcaagctgcaagggagccagagatatgtagtctgcatctttccagcctgtgattcataagaagacatgctccaaggagattgaaatagaatggaattagacagtctatgaaatttgccataatcagttccctcctttggatattcgatgtttataaaacattggttccaatccaatatttcaaatatcaataacatcatcaacatattattgaaatttcactttcttttttacaaaggaaaatatattcaccttctccccaaagtctcattagtcactgcacttcatctcttcttgatgtttattttttctctaacttggctataatccaaaatttatcttaatgtgcattatgttattcaccaccaacatactctatataaattataataggaaatagtgagtaaaaaataatgtaattaataaaaaaaaatactagaacaagacaagctagcacagtcccaatttctgtcattgataacaaggctatagttgtgataaaacataattctttctgtgtgtattcaatttttctttagctttcagctagaatatccagctattcagtattctttatcttgggaagtgaccccaaactttaatgctcttgatttgagcttgtagatccgccttcctaacaccagctacagcagtactgggagacacatacattctggatcagccactcaatttgcctgtgatgatcaccaccaatcaccacatccaaataagtaatcaccacatccaaataagtaaatctcccctttttgttgccatttgatgtagaggcacaaagaaccacagacagcttgttggctgcctcagctttcaagttacgggaagtattgtctcctagtggaagcgctcaccatttatgaactaaaatctctaaggcaggatgtccagagttatagttaaagggcaaccaagaattttccagtggattattaggtgtaactccctatcctaccctttgattcctggaaatatatcttctggctctgagaagaataataccatatatttgctgatggttcagttaaaacatcccaacttcactaattatttcccagttggcaccttaactgaaaattcttttgaccattttatctttccacagggtcagttactcctggatgatgggttatgtgttaagaccagagaattccattatggtcatcgtattgcttttgttcatttgcaaataagttctctattcagaagcaataggacatcatgactgagaaaaggccttgaataagggtggcactgacagaagcatgggagacataataggcaaatccataagcaaaataattgttaattcaggggagatcaaactactaccccttctaggacaaaagagttcagtgctcaatttactgctgatcgtagaattgttcacccagagtgtggcgctgtgccagagtttagggttatccttcactgctgatgggaaaaacacttgaagtgattgtatccagttaactttggtaaaaagaagtgtatattttggggcccatacaaatcttcattcttactagtctgactactttttccatgaacgaacactgaaatgactgtagaaagaaactgactgacgttcataggagtgagaggtatatttcagaaataaaggaaagatatgactctgcacaacaacctgaaagccccatatgttattatcacatgactatgagttccactgagccgtaacagccaggttcagagctgctggtattaaaccctaaatgagctgaaactactttgtatgttttgctctgagattcacccagggctgccaattagtttactttgtaagtggatcaaatcaaaacacttaaatgttgtgtatgcttctctaaaatccagagagttccatcaaatgttttgtctctttcttagtgttaggaaaagcaaggtattgcaatttgtcttttactttgaatgtaataagtccaagattgtgggatacccagaaacctcaatgtggtgggaatcccctgaatttttattatatctatttcccacctctaacactcaaatattttaccaaagattctagggaacttactactttctggttttgagattttattgacataatgacatctatatagatgtcctatgggataatgacataaacaaaatccctgtagatgaaactgtgacaaagagagttgatgtagcccaaaggtaagatagtgaaacggtcctgccctccttaccacatgaaagcaaagaggaaatacaaaaggtcaacaggtttataataagatattcatcctcactaataatcagagaaatgcaaagtaaggcaactaagagttaaccacttatcatccttccagttttaaaaatatatctataaaagtttgatagcattaggttttggttaggatatgatgaaatgagactcatacactgcttatcagaatataaattacgattgtcatgttggaagatgatctggtaatactgttaaaatatactatattaaaatgtctgactcaataacatcgcttctgatactttctcagtaatttgtatacatgaatttaaacaaatattaatgtctaagaatgtttacttttgaagatttgcaatgtgtctcaaggaaacacatatatattcacaagtaagtatctggtcacatgtgtgacagattttgactgtcatacctacttcaagaatataaaaaggaggcaaaacactgagaaaggatgtgtgacatgacttctttgacgagaactgtttctgcattctttatttgtacctaatgaggagactttccatgagacctcttcatctcctgagttctgggaacctagagagtgagagctgggatgattactttggtggtggtggtgtcagtcgagcttgctgtgccctgggatgcctgcagcatgggccctacactgtcacggtcagtcatgactgtcagaatcagttaggccgtgctatggagagggagaacagcatggggtcatcatgggtgcgattcagtagaacctttggagggacacggaatcccagaagccagaatctggactcttttccttatgtaattcaggatataatagtttggagttgggggcaatgtcatgaagggctcaagccttctcagagagctccatatggcagcaattagaaagctagagggccagtagcagcaattctatgagtttggactattacttgatatttctgggtctcagttaccatatctttcaggggagcaggaaagatagacagatagatagatagatagatagatagatagatagatagatagatagacagatgatagtgtgtgtgtgtgtgtgtgtgtgtgtgtgtgtgtgtgtgtgtgttttatggtactttatggctagttgtagcaatgcattctggattaacctacaaccttcaaaacactcctgtgttttcatatattacttagttttataaaaagtttaaagcctagtaaattataatattattaaatttataaatttaaaatatgaatgcatgagtataagtacagtattcatagtagcttttctggacaaataatgatgtttaatgcctaacaaaccattaaatcaatgatgataggtattattaatattaacaaaattgaccattaatatttattactttgtaaacatttaatataattattttcacaagtaatatactagatctcttgccttagtacacaattatccattaatattagaattagtacactctgaagaatagccttattaagcagttatcataaaatatgtagctgatttaataatgatttaaaaatacattgtaatagatcttcccttcccaaaatgaaaatccatatatgtaaaagtgtcatctgcatatacttaatacattgcttccctcttctaaaataattggattcatttattttattgcacattaaatattgattaagttagatcttctctaacacttgagatatataaaagaaaactgtattttaacttaaaaaaaatttccagattatcatagtattgacaaatatgtaaaatagaggttgaagcaaggtcccttaacatctgtggttatttcccatttatactttaatttataacttgaactcatgcttgtcttatagcgtgtcaaacaggcatttaaatagagaatctggctgttctttgtgttaatatcccttcggcatcctcttccttgtaaattcaacaaaagagatttctaccattaaagagaaatagctttcagtttgtgaagtacacatcttggaacatagtgaaaagtgtaatgagataaaaatatagccaacaatgggcacttttccattaagttgaacaaatattctagcagaaattccatatagttgtaatgagttttcatttttcctatttgttgcaatttatctaaagatgttggttttttaagacctatttctgagtttctttgtttcttccttgagcctttgaagcctttgagaatacattatagaatagtaaatagaattatcttcttttaaatgatttagcattcccatttctctgagtgcagaaagaactgggcaaattgtgttcatcctacattctacatatttcaagcatttattaaggagttattgagtagtgggtaggatcttttaaaatactagttctcaggaactctatctcatcaactgtaagctgcttctctcgttttattacacataaaatactctttactaactttacctacaacattggtattttcttcctgtttggttatctacatcatgcttatcaaatgaatgtacattgtatctttcttgcccagtattgaggcaaaataaacaagtgaataagtaagacaaagctccaatttgggggagtgaaagtctgataggggactaaatagcattacacatgcaaaaattacagaggaacaagagtcagtatataatcaagtgtcgttttctatgtcaggggaaataacagttttaggttcacagttttaggtggcttccagagaggaaagttactactaaaaaagttattaatatcttaaaatatttatattttcttatctcaatcttgctatcatcttcatatcaaacatttgtaggcattaaccattttcgagttgtttttatgttagttgttttatgtcacataattttcacaaccatgttataaaatggaaaatggaaatgcttctctccctaatttagagatgtagagatggtcagtgattttctcaagatcatttaacaaaggacagatatgcaggtctttttactctctccaggccaattgtttctttttcttccagtgattaaaaaaaatgattttagcagcataacatttgattcaataaaactgaatattaataaccccacacacaccaatatgtttttaaacagattgaataagcttctctgcatgatctgtgatgagtatctaggagtactgcttactaaagtcccttccacctccctgcctgtggtcacaatacaggatcctaatgaatattcacctaaaccctgcttcagttcttccgtatctcatttctttttaggcagctcttcttatgttgggcaacaataatatttaggaattctttcatgtgaagcagaattgcccccagttctatctgaaataaaccagttcactactctttgtcagcctcagtaatcctctgttcccatggaacagctctgcctcttgtcaaacagattactgttaaagtgggtcctcccagttctgggtgtctcatttgctaattcaaatttaatgttttagattttcttttattacattgtgtcccatgaaggtttcatgggccggggcaggctttttaaagatttatatagtgaaagggaaagggagggatccaggagctgtaaagataatgatgttctcagcatgccatgttttattctttgtgagaagctggggaagctgtaaagaaccctgaaattcagaaggaagggctcccactgggtgaagttgactctgagccagacagtgtaggttcttgagcaggattaatataaatttgtcagaaacttcattctggcagagcaatgtgagatgggatattcaagggcaaattagagaacaacggcagtttatcctcataaacctgtgatgacacatagaatacttggtttggagctataaaattggaaatggagatcaccagatgatttgaaaatgttctgtatagggatttgtaagaacttgttgcaaattacatacaggagaattgacagtgaagaatcgggagaaataggaaacatgtgcagcaagacattttgaggggaagatggcgaattctgtttgggaaccattatattggatttaaaataaaaataggaatcacttctgtagttattttagtggaagtcatggttgtggatgttcatctaagggaatgaaagtttagaaaaaaagaggagaccagagaaatagcctggaatttgaataacaggagcaggaaagaatggcattattttatgataactgcattgctttttcttatatttttacgaattataaattacattttatgattaggttctatatgaatttttacagagtaatcactgggacctccaggttgtccaagcaatggggaatggtcaggtcaggtgaacgttaatgtaacccaatgttctagtcaacaggagtgcttggcaagaggttcttgcctttaacctctatcctttaattgcagatatgttagtgttagtttctctctccctctcatttttcacaggagtatgtaacagttaatcaatttttaaattggtacttggtaattctccttttaagttattgatatctaaaacatcttttggttacctttcctaatcttcttgtttaagttttaaaaacaggcctcttaacaggcaaaaattccataatgctaaaaaatagctttgatgaaacaaattaggaaaatcaatcatgccacttagcatcatttttgaagtgtggtaggtagtatttactcagtctcataaacccacctagagttttcacttgaggtgggcttgggtttgtgtcctgaattttcaccatggttcactgcctggaacagcatgggtgataagtaagcagctgcatgcaagcattcactgtgtgaaaggatagaaaatctatgtactggctctttcagggaggcctcattaccgtagcagtttatcccattactaaatatgtgccatgctgatatcctcacattcagctgctgaccagcaacatggccctcagctttcatagggagcatatgatcactccagctggcaggtgacaccgtttggcaatgttccccagcagctcaacaaaagattttcaaatatcaaagcaagggaaaagacctctgtttttacaaggaaaatggctttaacatgagtgcattttgcctccaacagaattattgcttctaacttgctgaattccatgaaggaatgggcacacttagagagtaaaattcattcagggaatttgtaaaacactcatttgaattgataaatgaataaataaataaataattataagaaatttaattttgtattcaagaaagaagtgtgacttgaacatagttaaaggtggaaaagtcttttttttttaaaggttcaatctgaaaacacaagacaatcagaactgaggttaagttataaaaacttaaaatgttgaacaattttattgaagaaaggggcattactgatcttttagtaaaatatcatttcaccatatggaaaaactgtgggacagaatgatcactatctactcagggtcatgtaattcaagggcggcagtttaggaatatcttaaatctcttgactatgagcacagcagtcatcgtcctctgtcttgctataagtaacggtctcagaaacactgagaaatcctcctaccccattcattagtattgaaaaagcaaacaatagatttgtcggaaaacatatatatttcctactagcgttatattctagtactaaatctgagtataattttaaatataatctttttacatgaaagcataagagttgggactacagacctgtcaatcggctgatggctgtcttagcatatgtgaaaaatgcatctaccttgaaaagcttctcatttcctttttcttttatatatatatttttttattattatactttaagttctagggtacatgtgcacaacatgcaggtttgttacatatgtcaaaagagttacagtaacagtttgcatgtggtttaagtcccattactcttatattttgaaggccagtatttgaacagccattttcattcttgggacaaattatctaattaaataaatctgtggccatgctgtcattacaaagtatacaagcctacaaatatattttgctttacacaaaatgaatattttactctactctgaacactaaattgtttgttcacattacaaatattggggaaatttgttaatattgtcaagtgatgtcaggtaatatcattaatataaaaaagtattattaaatttatttgtatctttacaggaagaaaacatttttgtaactcaataagaatattataagtgcttattagagacattctacagaggctaaaaatgaaatattgctatggcttttgtttacagataatatattcttaagtgctaaaatgctttatatttatgaaaagtcatacaagcttatcacagtacaataagcctcataaaggggctaggaattgaactgggtttaggagggtcccattcataggttgcgctcatcaatcatccaactccaccagtgcagagcttctgaagctatctggggcaaagggtcacatttttggttgcttgttttcatttgatttcctactcttccagtgacatggtcttactgtgcatgtctattatgtagctcatgccacatgccactcaaagtagaattcaacagtaacaaaactggcctataccctgttcatcgagttgagtccactgatcatgcacatggatgccacagcaatttcaaattgctgtaaaattgcctcagtatttattctgaattcctgtgcttagctcattgcacaccccaacaaacagttgccttcattcatggatcacattttgactagcactgcactagtgggacttcctgaactacaaaggcaggaaactaaaattgatatttcccaaagttgcttgcagccaggtgcctggatgtgatttagattccaacaattacatgttctggagctgggcttagattctgaactgaggtcagtagggagaggcagagtacccatttcatggggcagtgtgtgccagcagcaacatagcttcctgtagccacagaaaatagctttatgaaaaagctttagagaaacagcagtgcaattctgagggctggaagttgctctggaaacttggcttagggctttttcctccagcctatccaattattggtaaactgcctaatatgtggtaataaattctatctgtgtgatatactgaatttctgttgtctgttacaagtagggctacattgatgaagattaagtgtaaatgttagctggcttatattttttgagtgcttgagtgtttttcaaactttattgtgcatgtggatcttctgggaatgttgttaaaatcagattctgatttgtagcatggagcgggggtctgacaaggtcccagttagtgctgatggtgttggtccacagccccagctctgattagcaaaactttagattagactaagccagtaggaacaacttccactccagtgccctagactgcagatgttaaacttcagcaaaatgatgagaaattattgggctcattttcatgactttccctggattagaagcagtggacctatggtgacatccaaaatgcaaccatcatttgtttttttccatattaggaagaaaagtttaaaaaatgttttttcatatatctgtgtctatatctatagatagatacatatatacatatatacatgtacatatagagagaggagggataaaggagagagtttaaatatgtcaattctaagtaaagcattttcaaacatgatttacaggtgacagttcaggttatgccactacagtgaagacatacaacctacccattttcaaaatgaaagaaatgaacattacagtcctcatggtcccaccgaggtccactttaaggccatgtgtgtatgatgcagcagtaacatgagtcccagtgtgtgagcgctcatctactcctgtggccttggctttgaactctgatatgcttgtgatttctaagaagcatatatgccatcctgagctttcaaataaattccagcctttacttctgcatctgtctgctcaacatttctgcctactggatatatgctggatatatccacatcaagtcaagaaattaatgttaaactcatttataaactgccagaaatttgcttctcattctgtgttctgcatttcagagaactgcattgtcattcgcaagattgccaaagttagaaacatctgaatagtttgaattccaggcctgctaatttctagctgtatgacttggagaaaacatttaaatttcatttccttgtctgtaaaaataaatcatatctcattaaatctgggaaaaaaagaaacattttttaaaaattgtgatgttaaagaaagctttaattattaaaaatatgtttttttaaagtgatgcatttagagaatagttcctggcagtaactattaaaaacaaatacatggatagatagagtggacctctgctttacaaagcagttttgaggattatctgagatattctaggtaaaactcaacacggtacccggttctttgtagacattcaatgatggattgcctgtattcatcataatacctcactcagtttgagtgcttcgtaagcaagaccttgggaaaactctttaacctccttgtactcagtttcttcatcagtactaagttgcaataataataatacctacttcatgaaattgttctgaagtctcagattaataattcaatacattttatatacataaacattagaacagtgtctggcacatagtaagcactaatatatgtttattgtaaatactaatgttatcatcatcttgagaatcttttttttttggcattttttttttattatactttaagttttagggtacatgtgcacattgtgcagattagttacatatgtatacatgcgccatgctggtgcactgcacccactaactcgtcatctagcattaggtatatctcccaatgctatccttcccccctccccccaccccaccacagtccccagagtgtgatattccccttcctgtgtccatgtgatctcgttgttcaattcccacctatgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctatcgtgaataatgccgcaataaacatacgtgtgcatgtgtctttatagcagcaagatttatagtcctttgggtatatacccagtaatgggatggctgggtcaaatggtatttccagttctagatccctgaggaatcgccacactgacttccacaatggttgaactagtttacagtcccaccaacagtgtaaaagtgtgcctatttctctacatcctctccagcacctgttggttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttcatgaggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtgatgcctaggttttcttctagagtttttatggttttaggtctaacgtttaagtctttaatccatcaacgttagacctaaaaccataaaaacctgagaatcttcttatcttcaatcttgtattgtaataattcattttcccacctcaccaccagaatctacgtaaaatacaaatatcatcttctttttgtgccacatgtttcaatggcattatcacccacaggaggtcttattctagacttacataacagcctggaatcagaccgaggccttcaatttccattcttattttcactgctcacccaaaactgtctaaattgagaccaaggaaaaatccattttctcccatccaccaataagcgaacaaaaaaaggctatttatctgatatttccattaattaccttcatctcaacatgacaaattctaatacgtaatttgaaattcaccatagtaacctactactttatgtaactttctgtacctcccctagcaaaattacatgcttccaacttaattgctgtaatcttatctttgtacttctgaagcccagtattaagtagagttacttaatacacatttgttgaaaggtttggggtattgaaaaattataaaaagataaactacatatatacacatacacacacacatatatgcacacacatacatgtatattatatatgtaaactatataatcatataatatcatatttttctttatgcaattaatttctcatatttaatacctgtgttgaaaattgttaacatttattagaaaaatatatctggtttgtcttttccataattcctaagttctcctttgggcaagcagcacatttgcaaagtgcatagatagtacaaatcctgtgtctttgagacagtgataccagttgatcacaatatatcagtaactttggcattggctaaaaaagcagttgctctaacaaacagatttatagccagtttaaactgtgagaagtgaggttaagaaaatgggccttgcttttaggaaatccaagtttgaattccagtcaactgcttactctgtgtgaactttgccaagttttctaacctcttgaaggctgctattctatggaatgggactaatagtgatctccagataagaagattattgagagtattaaacaaggtaatgtgagtagttttacattttgggttctaccaaacattcaaattcttaagattcagacgtctaccataagtcacaccgtcatcagtctgcttagaaggacacagaacaggaactggaatttgtcgttattgtagtatcacacattgctcgtctggttgaaattctcctagatgtccatgcagcacagttcagatgcaagatgagttgcatatcaggtaggtccaggagctctcctggcttaaaagctttatttcccacaagagctgcatctcttgaagtgatcctacagtcatagcctccaaggttgccacaagagacaagctctgttctaagagttgccacatgcagagaagcccaaagctgcgactgcttaccaggtgttcacagtgtccccagtgcaggtgcaatttatctcaggagatattttatcataaacaatataatctagtaacaagttgtcattcttcttttatcaggttaccagagtaactaactagaggcagtcaaccaatagtcatagtctctacaaaaagctgagattgttaatcctttctctgcacatacaatatgagcttaataagtatgaaaaagaggataatgtatacatatgaatacgaaaaaaatattaggaagaataagaaatgtatctaaaggaagtgaaatatgtagagttttgtaagagaggaattacagaagatgtcagtcattattttgcatgactttcattgataaactcataagtataaaagtgaaatcttcctcatcaaagagaaagtcttgcttcatggttagcatcaatacatgacactgagtagcaatgggattttggtcctctctgttgtagggaaaacagagctgactcacagagcccttttaccaccactctcagatgatcttcttcccagacccctcaactcagacaaattgactgtgatgctttgagctgtaattgtctcctggaaatgcaattttcatacatatgccagtaggattaagaagattgaacatgagttgttgcattaaaatggaccagcatctctatggttgattaccacagttaaatatagcaactgaatgatgaggcagaagaatcagtgcattttcccattggaccagatggctcttcatggcgagagctccctgtgtcttgtaaatatacactattgattattgagaatgcgcaagagttaaactacaaatcaacacaagtccatccaatttcacgaaaactcttcaaagtatatgtaccaccaattgatgacgtccataccatcatcttcatcttcatatgtaggcattataatttagaatccaccatccctttaattaaagtacaagtagatagataaaagtttgaacataaatactgataaaataaatattaaaggtatatttagtggatatctctacagtttttaggtaaatagatgtatattattaatacttatgttatatttaattaggaaacccacatgtatcctacgtgtcaaagtttgaatagaaaagtggatgtacttgaataagcatacattataattataattgcctgtaaagtttcaagtgatattaaaaagaatgtttaggcacatattaattttttttctattctaaacaatatggtgttaagttattatattagtcaagattctctagagggacagaactaataggccatatatatgagtttattattaactcacacaatcacaagatcccacaataggccatctgcaagctgaggagctaggagagccagtccgagtcccaaaactgaaaaacttggagtctgatgttcgagggtaggaagcatccatcacaggagaaagatgtaggctgagaggttaggccactctagtcttttcatgtttttctgactgctttatattctagactcactggcagctgattagatggtgcccaccgagatgaaaggtgtttctgcctttcccagcccattgactcaaatgttaatctcctttggcaacaccctcacagacacacccagcatcaatactttgcatccttccatccaatcaagttgacactcggtattaaccatcacagatccaccccttgtcaacttgaacccatacacatctccggagatgatacataatcttaaaataaagacaatagtaaggtcataattatgcctaacataatacaactatccttcgtacaaccagaaatgcaccaatccccaaaccaaatactattacataaagttaacaatacttaaatactgatatgaagtcagtaaatcttatgtcacatgataaagggaaaaggaaataaaatgaagacattttcttagtacaagtgtatacataaacaaacatgtttttaacaaaagaaggaggaaatactgatgacaattacggtcttcttttctgcagctggccacgtggtcgtagctggtattgatgactaccttcttctgctactcattctgtattccctttgccttcagcaagcacctcagcagtctgtggtatttttcctggtggagtgacccaaactttcatttctgaagagtctgggccagttgtagtcctgcctggatttggctgttgtagtttcccattgaccttaatcacagggcatggtaatactaagagacgccctaattgatctcctgtattccatgcatacttttccttatcctatccactttccttcctattgaccttaatcacagggcgtgacaatactaagggacgccctaatggatctcctgtattccatgcatacttttccttacctctgttatggagtagtaaactgatttcatcttgttagtctgggtcaatcaccccagccaacactgtaactcccttcttagcctgttgagttaaaggtagaaggagcccaaagtgtccaggtagcaaccttaacttccagtttaatggaatcattgttgtgtctcctggtggcagcattcctgtctctggaactaagacctctaggtcaacagaacgtaatgttgcaggaacaggaagcaaaaattttgctagtggatcactagggatgatggtgagtggagccacttctacatccaacccttgatgcctggacccatgaattctggctatgggagaaagagtaccatatattgcatgctgattcagagcattcacggccgtctggagaactttgccccagccctgcaaactattgttaccttgtttacgttgtaattgtgacttcaaaaggccattcccccataagtgctggcaaattgggcacttagcagtggccatagccaggtcagccttggtgagtggaagtccatgttgctgagcccatccataacctccatctgtgccactatggcccctttgttcgtgggcccactgggcgatgacaggggtggctggggaaagaggctgaatggtgtccacagaacaggtcatcctatccacttgattattaaaatcctcctctgctgaggtcacccattggtgagcactcacatggaatacaaatatcttcacagttgttgaccactcagagagtttcatccatacacctcttccccaaatttctttgtcaccaattttccagtcatgcttcttccaagtccctgaccatccagccaaaccattggctacagccaatgaatcagtatgtaatcacacatcaggccatttctcctcccatgcaaagtgcaccactaggtgcactgctcgaagttctgctcactggtaagatttcccttcactgctgtccttgaggggtgtcctagaaaggggcttagtgctgcagctgtccacgttcaggtggcgcctgcataccgtgcagaaccatctttgaaccagaccctagtcttctcttcctctgtcaactgatcatagggaactccccatgaggccatcggtacaggctggggaagagaaggcagggtggcaggagtggagaccatgggcatttgagccacttcctcatgtagcttacttgtgccttcaggacctgttctagcctgatcacatttataccacgtccatttgatgatggaatgctgctgtgcatgatccactttatggctagatgggtcagaaagcacccagtacatgataggcagttcaggtcacatggagacttgatgacgtataatcaaacgttcaatttccaccaaagcccagtaacaggccaagagctgtctctcaaaaggagagtagttatctgcagaagatggcagggccttgttccaaaatcctagaggcctctgatgtgattcacctatgggggcctgccaaaggctccaaacagcatgcctatctgccactgacacctcaatcaccattggatatggggggtcgtatggcctaagtggcagagcagcttgcacagcagcctggacccattgcagagccttctcctgttctggaccccactcaaaactggcagtatttcaggtcactcggtatatgggccagactaacacaccagttgaggaatgtgttccctccaaaatccaaataagcccactagccattgtgcctctttcttggttgtaggaggagccaaatgcagcaacttatccttcaccttagaaggaatatcttgacaggccccacaccactggacccctagaaattttactgaggtagaaggtccctgaattttagtcggatttatttcccatcctctagcatgcaaatgtctcatcaataagtctagtgtgtttgctacttctagaactagatctcactggatctaatcagcataatgtcatcaatgtaatggaccagtgtgatactttgtggaagtgaaaagcaatcaaggtctttctgaataagatgatgacacaaagctggagagttgatatacccctgaggtaggacagtaaaggtatactgctggccttgccagctgaaggcaaattgcttctgatgggccttatggacaggaatggagaaaaggcacttgccatgtcaatggctgcataccaggtgtcaggagatgtgttaatttgcttaagcaatgaagccacatctggtatagcagctgcaattggagttgccacttgattaatctgacgataatccactgtcattctccaagatccatctgtcttctgcacaggccaaatgggagagtcgaacagggatgtggtaggaatcaccacccctgcgtctttcaggtccttgatggtggcactaatctcctcaatccctccagctatgcgatattgtttttgatttaatatttttctaggtagaggcagctctaatggcttccgtttggcctttcccaccataatagccctcaccctaccagtcagggagccaatgtgggggttctgtccgctgctaagtatgtctatgccaattatgcattctggccctggggaaacgaccacaggatgaatcccgggaaccactggacccactgtaagttggacctgagctaaaactccattagttacctgacctcaatatgcacctactttaactggaggaccacagtgatgttttgggtcccctggaatcaatgtcagctccgagccagtgtccagtaatccccaaattgtctgatcatttccctttcccaatgcacagttacccaggtaaaaggccagaggtttccttggggaaggatggaagaaagattaacagcataaattgtccataatgtagtggtgttcttccccaaggggacccagcctccctttcattcaagaggttctgggtctgtaaactggctcaagcctggaaattgattgaggggccatgattctctgtttttataattcaaatgtcttttgtccatttgacctagaagttttctgcctatataaattaagtaggaatacggtaggcttcctatcaatttcacttctaggaacactatgattaattaaccaatgccagagctctacatgagtcagactattctgattgctgctttgcctctgctgtccattacgatagctatgcccgccttgcctttgatggttgagtgccgccacttggcccttgccacctcaggatccaattattctcattgtatttaagttttgtagttgagtgactttggtttccactgttagatctgacatacagagaagagcaattactggacttttcaaagatgcaggtgctgccctcacaaatctattttgcaaggcattggtcaagggtatgtattctggacctcctagctgggatgagtaggtataaagtgactaatccacttcaccatcccaatctccctaagcctttggatcccttcctctacattaaaccaggggagatcaggcatttccagctcgctcacaatgggccatcttttatccatattttagctaaccaagcaaataaaccattagaacctttttttaactccccaagctggaacattaaatgcagaatccctacttagtgggcccaaatcaataaattcagcctgacccgactctatcttccttccaccattaccccacactcttaatatccattcccatgcctgttctgcagatttctgtttatattaattagagaattcaagcagttctcaagtgtagcacacctcctcatgggtcacactgtcaaccccacctctaggggcctgccaggactttagtctagttgtaggtctagaagcaaacaggggtgttgggggtggctcctgaggagaatcaacattatcttgcctggcaactgcctcaggggaggccatcactgttgcctcaggcagtgcagggtttatctcctcagacaaaggtggaaaggctgatggcagcatgggttggggagtggatgttgtcactactggggatggggaagctttttcttctggcaaaaaagattcatcagagtttacaaactcagtgtccccagcttcatcagggtccccccacacgtctgcattccaagttgcagggtcccattcttttccaatcaatgccctcactttaacagtagacacctggtgaggctgtgcatgcatctttccttgcagatgacccactcacatgataagagcttgtgtctgtttttccacaatttcggctccttctcaacagaagataagtctttcactcaggacaatttatctagcagatttgaggctcagtatctgcttatgaagctaggagttagaatccctgagtttatcattttctttcatcacttttccattgaacttaggagcaatggactagcttcattatgtttcttggttctccatatatggtcaaaggtgttatatatagagtctctaaactccttgccttcacaagcaatgaatcaggagcgtcaaatgcatttattttgcataactccctaaacagttcacaccaaggactatgagtgttctccatactattagaagtagagtccttagcattttggggtctaatattaagcagccaactccagaaatcccaaaaccaatgaaagaattccatccttaatattctgctcctgtagaaccactcctggtaccaaaatctgtcttagtcagggttctctagagggacagaactgataggatagatatatgtataaagtgtagttattaagtattatctcacatgatcacaaggtcccacaataggccatctgcaagctgaggagcaaggagagccagtatgagttccacaactgaagaacttggagtctgatgttcgagggcaggaagcatctagcacgggagaaagatgtaggttgagaggttaggccagtctactcttttcatgtttttctgattgctttatattctagccgcattggcagctgattagatggtgtccactcagattaagggtgggtctgcctttcccagccagtgactcaaatgttaatctcctttggcaacaccctcacagacatgcccaggaccaatactttgcatgcttcaatccaatcaatttgacactcagtattaaccatcacacttacgcaggcatatttacttgattccctaaacagaatggaaattagcatatgttaacagttcttggtttctcattttctaagttaaaacaagtctggaatgagtaaaatgaacagtatggtaaacttagctttagctaattttacttaattctctttattttctatttcctatgaatggtttaacaactcttagaaaacagaagaatatgcaaatgttagctttgagtctaactgcttttccacatcataaatgttgatgtattttcgatgaaactggaatcacacctccaagtagaaataaaaatgcccaagctgattcactcttgagcgtagaagacaaagttcataactgcctgtgagtctgtaatgagaatatcaatgctcttttacagcttttgccagcaagagaagcttccaatgaccttccagtcctgtgtgatcaccaaagagtgccaggtttccgagtggtcagagtggagcccctgctcaaaaacatgccatgacatggtgtcccctgcaggcactcgtgtaaggacacgaaccatcaggcagtttcccattggcagtgaaaaggagtgtccagaatttgaagaaaaagaaccctgtttgtctcaaggagatggagttgtcccctgtgccacgtgagtaaataaagaagggtatagcgtctgccgaaactacatttgctcagctatttgattttgactgaacagtactctaagcaacagtaatttttacacataaaaaatatctttacaaacagtatccttaaaaaaaactttttttacagaataaaagtgtcctgacaaactaaatctccatgaaatttttagcaccaattctatgtttatgtattttctataataggagttgccaaaatttttctgtaaaggggtagatagttaaaacattaagctttgcaggccatacgtgtctctattgcaatgactcaacactgctgttggagctagaggtaatatgtaaacaactgagcgtggctgtgttccaatacaattttatttatataaaaaaaaaggtggcaggttgatatgatcttgggccacagtttgtcaacctccattccacaaggtaaaataaactttccaaatatagattatcgttaactattaaaattcagtactttgtataacaaatcctattcactagagtaaaatactacatcaaaataatgatactttaagttccatgaggacaaagattgtgcttactaatatggggaaaagggttgggttttttgcttgtttgctttttgtttaattgctagcatatatcacaatacctggtacaaaatatgtgttcaataaatattcattgaattcagattaaataagactcattctgaaacatttggcagtatgacagtattaaaatataatttccaagttatcattgtgaattattttggtaatagcaatatttcagcttaatctgtatataggatatttataaagcaacttatattagtttttcaatagagatgtgtgaacttcattgagagcatctctggattattccaaacatttaaagaacatgcatatagctagatctttatgaaccagtggggaggcaaattactactactactattcctataacaacaacaaaaaaaatagtaatgttttataccagatatataattctgcagcactttggactcatccattgtgttctaatgtgaaaagtgactgaaacctccacagagaatttcctccccaatgtctctgcctatcccactgattgttctggttcctccccacataataggctcaaggaagttgccaggatttcctgtattttctctcctatgagtttcctctatttttgttgcaagctaagtgctttattctttttcttctcagatattcaaacacaattaacaaaataaacatatatccttgagtatctttctccatgccctttttggggggaagcatttttcatagaatgtgtaaccaatctaaattattgacaggctattcctctcattggactttttggcgtgacctaaatcagaacttcaatttatttagaacaattattgcagctcccttaacaaatgatctatttggttttgcttccttccccttcaatccccaaaccaggcatcaattattcgtgtttctataattgacctgagtgctgcacttcctttataaattaatgtcaggtgttgtttcttcatgacccagtcccacaattcgttaagcaacaaatccccacttataaaatttaaaaacaggcatgaagttcatctttactgtcacaaaaccttaccactgacagagtgaagcatctagattagacatctgagggccgtttaaccttctgcctgattcagatgaatatttgcacatccatttgcacctatgttggctgttcatctgattactaaggaagcatcttcgttaaagtgacacaaagtgctacatgagtcatgttctttgtgcttttagaacatccattttccttgaggtggagaaatgccatcacttcctgtcttcggtggcatcgagaaatatttccctagctatctccttcaatcacgtgttggactgacaatcccctgacatttttctcacatcataatcttgattggagctttaattgagcatcatagatcttctttcctgtgctccactgatgagaagtgccagctctttgcatcatgcatccgcactcattaggaatgctcagtgctaccaaaaaaaaaaaaaaaatcttattcttgacaataaagagaaaactctgatttattgtcttataatttttaaccctaatatacaagcataatcttgctacactgtgcagttttcatttattttgtaaaaggcaaagcaaatgttttggttcatcatcactcagaatgtttcccattttcatattcaatccacctttgtttataggcaacaagaaagggcaagcctgggttcagcttaattgaacataaaatttcatgttttcagcattgtgctcccttttcataaaatatttataagtaacttccagtaattgcaattgaaacaggatcaccctaaatttaacccctcgttaaatggagcactgcagagcataaaggagttgaaaccaaatatgcaccatagatgtagtctacgatggattctctaggaaaatgattttgagactaattttcgttaaaacaaagtatgacaggagtagagaaacacgtcattcaataattatggttgctgctggtggtgttgtctttatttaggtatggctggagaactacagagtggactgagtgccgtgtggaccctttgctcagtcagcaggacaagaggcgcggcaaccagacggccctctgtggagggggcatccagacccgagaggtgtactgcgtgcaggccaacgaaaacctcctctcacaattaagtacccacaagaacaaagaaggtaacctttgctttcttctcaaggattcacttatgaagactgactgagcatgtgattgctctgaagggatatatacacagccatccaggttatgagggctgcatttctgttcacattgtggttggtattcactatggtaaacagtaatccacattatggttgtgaaaatatttaacacaattccatctttggtcagttctggtttactgacaagtttctttaaaattttgacttaaaggccttcttgactcaacctcttcatcaaagtttagcaggaataatgtaaaaactagacgaaaatttatctgtaaatatacacatatcatgcaaatatatattctaaattccaaaattatataagaagtaaaacctgcttgtcaaaagaaatcttatttggataaaatgtggttaaaaataagttaattatgatattgaataaaattgtcaatttcaatttaaataagtacagaatagaaactacagtaaaagaaaactttaacccaaaggcattttttaaaactcttcagttgtttggcagataaatctttttttaattaaatctgtttcaggaccagatataggaagtgtacaaaagaataagtgaatacaaaatggcccaagctaaaactatatattttagatattaatatgactctaaaattatcataattatttgattaagtgtatattgaattagtacatcttaagttcacacacaaatatgaacatctttaagcagtactgtaagcagtctttatcctccttctgtctgaggaatagcaggacttctttcactgacccattgaacgtatattaacatatacaatttgtttaagagagtgaggatagaaataccaatacagattgcatgtcatggaagtcctcaaagtcatcaggagagcatgtagacaaaccagtaattaaaatgcaatatgccatgccatacaaccaagtttcagaatgagcgtaagggagtagtagaaatagagccctttatggagggagtggcacttgagctcaatgacgacagagacactacttgcagggaagcatggcaagagtgcaagagggagttcatttcaggcaagggaacaatgtgtatgaatgcacaatgctaaagaaaagcaaaaaccaagggtaaatctcaccagtaaagatgggcgtgttgtatttggcaggttgtagagacgggaggggaggaaaggagatgagaggaaaggattggatttcctagaaaataccttggtagaaaaagaacaaggataaaggccctatttgataccaccagatgaaataccaaaaaaggagaatattttgggaaggaatatgagcaaaaaggatcagaaaataaggtaaagaaccaagagaaatgaatgtttttaaaaccaaagaagagatggcttctctgcccctcccaaaaaggactgacaccagtgaccagtaattcatggaagaaaaaaactgaagttttgcagttgcaactttcaaaatttaattgttctgtatccactaactttacacagcatgtcaactcatttaggagtctagcctagggatacattttactactaatgtatcttgaggttataaggaagtaacataaaacatgtaatgttaggacattaatattttcttggccactttaatggctgcattttaacactcttaagtagatttattatagcagtctttccagggtagtataatttcattgctagaggtagatcagattttagttttggaatgtcaattatgtcctgtaggttattgctttccaaagatccttcagaattctgaattgcaactgggtattttttttaaagcattttcttttagagctccccccaaccactgctaaatcactgcagacaccaaaaacagtcacagaaaaagaaggaatattgcaagaatatcattattaagatgtagttgttagactaaagcaaatgccaaagcaaaggtcaatagatatggaggtaactaattcacctaaaattaatatttatcatgtaaatatgtaacatgaataatttaggagtgtgtgtcctttcatatcaaataccaagaatactaacgaacttcttaaagtctttgcaaaaacagttaattctccctaaaaatgtagcatttattccaccaaatttagactatgttagtttctccccgggagcacttaacatttcccaataggaaacatactcagtataccagcatcccaggggtgacatgcgaagtctataaatatgtgtgaatggagaacaattaggctgtgggcttgaagattattcacactcgatgttcagtcatgttcatatgaaagaatgtaaagcttatcttataaaagagagaaatccctcaaaacaactcccccagctaataagaagacactcatttcaagaatccatgactgtgtaaccatgaacaacctgtactatgaacaactcagttttacttaaagaactatctacactgttctctttgcagtttcacaccatgtgttctctagatgacttgttttcacatataaccaaggtgtgaaaaagaccctaacacaaaacaaaatactttaactcaaaaataaagtgtattagtacaaaaaaatactgaaagcaagtgatatgaaatttatgtaaacttcctttattaacttggtgcattgtgttacacaggggaatgatactgactaccttagcataaaggcaggaagcattaataacttttttactcattggtatattctgtactactaagtgacacacaccataagggacagaaaaattcttatcctcggagttaatacatttaatttccaaaataataaaatgtatcttattaaagtactcacaaggtctttagtaaaatattcacaatttagtatgctatttgtgtcagtagaattatatcatcagaacatatcctaagttggagatagcacctgtaaagagtaggaagaaatatatctcatcaatattggagagtgtctatattttattattgcactgctcttagctgtaggtaaccctcccaatcctgacaactattcccccacaatattcaggtgagcagaatttctactatatcatttccgtagaagaaaggcttgacaagttccctactgacagtgtcagtagtaaaacccttgacagtttttgttcagccagctgatatgtgaagaatgtccagcttatgctggcgtgaaatctacccttatcagaatatgacaggaagaggccttgcctgtggggaggttatctgtatgagtcctagaaagttgatgaacatcttgctgatcattggatgcatggaagtaaattgatttttttagagttcaaagtaaaatgaaagtagattttacctacagtaactcaagaaattcttccatttagtacagattgaacatgtttttaagtgagggaagctgaaagtattggttataagacaacattaagtttacagtgacttataggaaactgaagagcatttctctgtagaaaacatattaaaaatccacactaaaatctggatattgtctgtgggattgagggttattaagaaagacagcctagataataagcctgtatgatgacatagaatgagatatagcaacagaaaggattggaggatcaatgggaagataggcggagggatggatgattgaactgtgaatggatagacggaaaggtaagtaaaaaactcgcatttcctcatgctcaacaaagaaataagaaaataaaatagtcacaccattgctaaatggaaagtaaattatttatcactatattttgtctacggtttccacacataaacccactttagaaaaagctttttggaaaaagagaaaagaaaagaaaggctatgcattacggtgctattttcctgttattttagaaagtaaatatcagagtgtgttgaagtcttgtgctgtgtctttcctgttcctcacttttgaaataaaaggtaggtaagaatattttacatgatagttccacctgaagtgtgtataagggaaccatgtgtcgctgatacctaagagagtctccatagattctcagatgcaatccttaagtcgtttaggaaagggagtggtttatttttactttctattttgctaaaaatatatcaaacctgtcccatgaagaaaaatgatttcatgttttttgactttctataacaccattatgtagatgtaaatcacaggaaaacaagatttttaaatttactgacttctaaaactttcactagtatactataattatacaaacaggcatataaagtttggctatgaacactttttgagaataatataagtataaacactccataatttattgtatttctaagcataccactttctgctcatcttaatatggtaaatgaaaaaggactagaacccatgatggctacagcttggaaacacaatgcactgtaaatacagtgggatgtaaaaagcactggaaaataatacggcaggtcctcaaataatgctgttttgtccatgaacattttgtcataacattgacgcgaaaaaaaaaattgattcccagctgaggaatgtggagtctgcatgttcctcccatgtctgcatgggttttctctgggtattttggtttgctcacatgcctcagagatgttcacatcaggtgaattggcatgtctacggagtccctgtctgagtgagtgtgggtgtgtgtgtgagtgcaccctgagatgggatggtgtgttgtccagccacagttcccaccttgctccctaaactgacggaataggctctggccacccacgaccccagactggaataattaggtaatgaatgatcttacttgtttttaatctttcttaagtgtatgtaagcttagatttatttcagtgtttaatattaaaagtgttttggtctttatttagaagtttagtgatgtttttgtgaccagacgtatgcggtgggaacttaactctcttgtttatatcaattagcctatggagaaatgagttctcttttaacgatcattagtcaaggcttccaagaacctattggtgacgttaaatgaggacttactgtatataataattaaaacataggaatccccaaaggaatcagagcctccttgttagccagtcctctgtatatcttgtgggagagaacagcttttaccctatgaaattactctgtgatcactggactacaaaatggaaagtgagatgtcaagaggttcagctgttggggtaaaaggtaataaaaactcatgctgggaattagattaaggtagttagttgtctacccagaggtaatgtaagagtttttattggagaaacagcttactgatgagacttcaggaagtattcaaccaaaaaggcaaagaaacatatcatgaggcagctcagaagtcagataaacatgagtactgtgctttgtacctttgacttggtaggtttttaataaacatttgctgtttgatatatttactgttccctttataaaatggtacaatctcttttaatttgtctgaaaattatctcttgaatatttcaaatatccacccccacttccttaaattctgtttcacaaagaggctatattcgcactcacactgccttttatctctgaatatagaactgtttacacctctgaatttgaatagaggacacatgatctagtccttaaatcaaatgacatgagtcaagattcacacaccttgttttcagtttggacactaatttaagggaacagtttttatttcttttatcttttctaaatatagtatatactttaaaagtcttttaacttctcatcttaaggctattttcaatagaaccccagataggaatcaggaaacctggttttcatttctgcttggcatgtattcttaggcacattacttaactttatttgcctgaagataactatttataaattactcttctgttcccattcaagctatgtgacagactagcttacacgaaaaaacagcctttatataacacctagtcaagattcacacacttggaatatattgtttggggaaaaaggtagaaacattaaacactcttatattttattaactcattatgcatgttaaaaatttaagagtaattatgaagtaaaaatacatatttttgtttaataactactaatatatttgtataattatgtattatacagtaatataatcaattattaataattgcatatatattttttccaatgttgttttaaatgatcttaagggcagaactgaggtcttgactaactaaatgattccccagaacaaaccagcaaggctgagctgctgatgctttctgtggttgcccttgggtggggatggtacaggaaaagtgttacacattttgggaacctaggaggagtgaagccaataaggagcatgacacagaaactttagccagagaaagagaatacaggcaaaaatactgcattacttcattaatctcaaaggataatcaagtaagtagagaaactcaacttacctgtagagggagatgacaattaaataggtcagcctcagtcttaacttaggagaaaaataagactcactaagaattccaattatgggtctgtattcatattggttttagtttcaaacttatgcttacttccatgagtccaaaaactgcaaagctgagaaattaatataagaaattatatcattccactggtactactagaatgcctgaaataaacaaatgcaaaaactctctagataaaaataccttaacctaaggcacaggatttacccctgtaaactgcaccatccaaaattatgaattatgcaaggaaaaataatccatcataaacaggatttaaaatgcctaacaagcagtaagattagactcccaagattgaaaatactgtattagaaatagcagatagaggccaggcatggtgactcttgcctgtaatcccaccactttgtgaggctgaggcgggtggataacttgagtctgggagttcgagaccagactgtgcaacatggtgaaactgtctctaccaaaaaaatataaaaactgccaggcgtgatggcatgcacctgtagtcccatctacatgggaggctgaggtaagaggatctcttgagcccaggaggtggagattgcagttagccaagattgtgccactgcactccagcctcggtggcagagaaagaccctgtctcaaaacaaacaaaaaatcacatagagaccataaaatgctaaaaacttattaaagatttaaaggaaaaactttacaagattaaaaataatgagtcagatttaaaaagaccaattttttaaaatagtagttttagaactgaaaaacacattcactggaaataaataaatgggtagtttggacagattgaactaaagagttattagcaaactgaagacaaaaaaaataaggaaataattgaatatttaacactgagaatagaagttgacaataaaaatgaggataatagtcatgcagagttgacaagaaggttcagaatataagaatcaaaagcaagggagagaaaatgctccagaagtggtaaaaaaaaacacagatatacagaattaggaaaaacaagaattttcaagcaggataataaaatacccacactagggacaatgtagtgaaatttcagctcaacaactacaaagatatgttgaaaggaatagagacaagaaaaacattatttacaaaggaattagcaaattaatagtgaaattttcagcagctacagaaaagcaaaacaacactaattatatattcagagttctgagaggaaagtaactggcaacgtagaattatttacccagctacctaactttcaaaagtatgggcaaaatttagacaaaggtgaaagggattgccttcaataaactctcactgaaagattgccaaaggatatttaagaagaaggaaatcaaaccaagaaagattgattaaagatgagaaaagaatttggtaaacccatggatagtctaattaagcagagatatgtatgaagcaatactaatattataatgtgcatttagttgatgaacaaaaataatataggataggaaacaataaggagagtattgcttaggaaaaaggtggaaatattgaacacccttctattttactaacattatgcatgttaaacatttaagcataattattaagtaataatacatattttggttttaataactattaatatattattgtatacttatgtattattatacactaatataatcaagtattaataattaagtaatgtgcatatatattgttccaatccaatagaaaaaatgaaagaggctggataaaatttaatcaatttaatagaagtactaaataagaaaaaaataccgatttttttacacggactatctaataccaaataaagactagaattggagctttaaaatgtcagagtaaaagattattacagaaaattattttgttctaactataaactgcatctgagagacaaatcagctgtattacaaatgtttacagtgaccaaactaagagtgtggactattgagtccaaacagtcaccaccgctggaaaatatgtaagcagactaacagatcacactgtgtattaatattttctagtcaataatgccaactttatatacaaagcatggtaaaaatcatattttttcaaggaaataacaatattagtttgccatatatgtgtacagtgtgtcaaaactattcaggagagtaagaggttggatcaattaaatggcatttgatagaacattttcttagataataaaaaaaaatgcccagaattttctccaatatttttagagtgaaggatgatctttacaaatgtaaaattcagaagcaatcatgttaccaaattgatattgttcaatgaagcatgaaagcaattgccaacttctaaaattgaaggatagaaacatgtgaaaattcatgagtatttcaaacctatctctctttttatcattctagtttttcccagtttgctaatggaaaagacaaaaatgacattggcaaagaaattattacccagacaggattataaaattcatggtgtatattggtgtctggtacaaagtcatggatgatgtactaataaagtatatgagtcatattaagctaataataaaatattggataataatcttgtgacacaggaatattttaatagactacaaacaatagaatatctctaacaatatgaagaataatgagtacgtataaatacccagttaagtcccaaatgcccactattaaaaagtagtaataacaatgatgataatgataataacaatattaattacatttattaagacattatattaattatttggttgcttcaaagattaaatgtgtatgttgggaacacacacttgcaaggatttaatattaaactcattctatgttcattctcccaagtgttatttttctgaccatcaattacagtagaggaaggattgcaaatttaggtatctcacttattattctttcattcactcaacaaatacttattgaacaattattaggttacaccactgatttagatgttgaagatataattttttatgtttttattttattttaatttgtattttaagttcagggatacaagtgcaggttcatttacataggtaagcttgtgtcatgggggtttgttgtacagattgtttcatcacccagatattaagcctagtatccattagttagttatttttcctgatcctctccctccttccaccctccatcttccaaaacaccccagtgcgtgttgttcccctctatgtgtccatgtgttctcatcatttagcttccacctataagtaagaacatgcagtatttggttttctgttcctgtcttagtttgctaaggataatggtctccagctccatccatgtccctgcaaaggatatgatttcattcttttaatggctgcatagtattttctggtgattttttaaaaaagtatacttgatacttgtcatcaggaagtttatagcctgataaaagccttgaagttatagctttgtgtacttggagtttagactgacccttcacaaggctgacatagggtgacttgtatggatctgtcagtttggggctgtctaatccctgagagtgcactacaccatggtccgtccttaataacgaacctgtacccttattcctcaggtgaattttttttctctaaagcatatatcctcaaaatatagtttaagaatcacctgcatgctttaagaaaatgcagacattcctagatattacccactggggctgtaattctgtaggtcctgaatgaggcaggaatctgttttttataaggattgtcattgattataatcaagagttgattttaccatgcagctaatgagagtcttttgggacccaaagcttatgcgatttagagaaccctaaatgttattttaaaaaaaacagccagatttcaaaattccaaattcaaaatcactcactaacatctctgccagggccttagaagggcccaaaccttaagcttcatgggcttctcaataaatctacccctaattctaacatagatttttgtcctctattacagccagtgagaatgactactttaagatgagaaacagaaacacatgcattgtttcttgaaaagccttgttttccccatagttctagaggtacgactgggaagaatggaatgactagaaaaagtcactatatattttccaaagtgaactggacctttcagtaatgatattagtcttttctacattctttgaccccccagttttagatccctgagctctaaatctttagaaactcacaatactttgctagtatttaagctgggaaattagggaaggatagatactgtttcatcttacttcatacctgtaacctgagatggaaagaagacatagcagttaatacagaccttccattaatgaaagaaagatggtggataaaatgtcatctaacctgacactatcaagggactatagtatccgtgctttttgtaacccttaagcacttatttcatcgagttcgttgtagatgaatgatagcgccaggaggaattttgaaatgagcactcagggatgtgcactggtgaatgagtagcattttttcagaggcacactcctgctatctaaagatgtaaaagaaatggtttgtggctagggctggttgttccctgccttgctgatgattgctcaatagggagtagctactctctccagtgttaacagaggagtgcaaactacattgtagaactcattaatatttattccttctaaaagcaatgggcaataaaaagggaaataaaccaaggagaatagcaatgggaaaagaaaactgtaacaacagattcatcttggaaaggtctcatcatttattgcacacaaaaatatgctcaaaatacaaggatacagctcatattctaagtttgaaatccactaaaattgcctcttattggggaaattaatttaagaaaaaaatgcacattgaatgcaattcaagaactcaaagtagtaatctatattcttgtaattatatgcactggttgtacctcttcacaattttacattttctgtatttgacaaagttacatgtcctcagtgtcggaagctgttttgtatttgtggatgcacaagaactctctctaagctaagcatcacctatccattgaagcaaaaccagtgctatttcagttccttttcttttgcttttcctctattttctgccttgtaatgccttcaaccattgtcccaattatccaaatatctcctcttttaaagaatatttttcaaattacaagaccttaatcatcttcctttatccaaagcctgtatagcccttttctgctatatttcttgatttgccatttgatttcatatgattatattctattcatgccaacttcccaagattttaagcttctgagagagggcatagtgttttatccttccctaaacttctttagtacaacctatcattcttagcagaggtctgggtacatttaccaattgtattctttggaaatatcttttaaaaagacagagaaatgccttcagtcagaggatgttgacttcctggacatttaatttataaggtttcattttgaattaacctatcttttgcactaattcattctatatctcttatgcttttctttcctttttaaaggcttaatgagatgacatatgtaacatatgtaaatcatttcctagcataaggccttgcatttattatatgccaaatgaatattaattgcttttgtttacgtgtttacttttctggttgaattgagaaaagggaattttttaaataacagtttcgctccaaatccttagcatgcaataaaggctaattgtatactagcttgctagttgagaaacataatggagagcaaataatactgtctctttacagtatgtgttaaaatcctgccatgggctaacattatatacaaaattgtccctttcttgggaaaaaaatagaccttttctaaagctttcattgtattattttagaataagaataaatacagttaattttacttctatagttatggtagtcagaataattacagcttcctttcctttgtgattcagaagccttgcgaattttaagtagtagtccattgctgaagaattctgacaaagatgcttgtagtaaccctcggattgttaggttactctaaaacagcactttcaccattgctcaaacttggaatgccacgctgttccatctgccccttatatcccacaggatttctggggatctaaaatgcccagatagggagctttatgcctgggaaaacttagcccttgttgttaaaataataattatagcaactagatacataaaaacatagggtttagaggccagccatggtggctcacacctgtaaccccaggcctttgggaggctgaggcgggcagatcacttgaagccaggagttcaagatcagtctggtcaacatggcgaaaatccatctctactaaaaatacaaaaattagctgggtgtggtggcacatgcctgtagtcccagatactcaggagactgaggcacaagaattgcttgaacctgggaggcagaggttgcaatgagccaagatcacaccactgcactccagcctgggtgacagagcagactctgtctcaaaaaaataaaaagtaaataaaatagagtttagaaaacacttctattgttttatatgtgctcagctagatctgtttagaaagtcttggatcaattaagtttctagttcattaagaatcccagaagtactgtgaaaatacagttatgtttttaactaggaaagctattgacttatttatcaaagccttctacaaatctataacaagggggtaagaaaagtccccaacatattgcggtagatagtgttttcccattaatacataactaacctgataattagagaataattttctcagacatactgaaacagtcagtggcaaaacatggactcaatgccttgtttttgactctaaagtgtaaactcattgcaagcatactcgcttcccctatgcatttgcttcagaataaatgccctgggtataatagctgtctacaagtttatcaaaatcatcagaagtgcatcctattagctgataatgtttctgttgcaaaaataaacaaaaatggcctagaaatctacttcttataaaagaaaattgaagggaaaagtataatgtaagccctttataggagccaacgcaattaagttcattctgtgacatgattctataaggtcaatatggagtcttgttcacagttatttgaaccagcattatgttgaaccatatgatattgctatttttgtaggtcaagatctgtcaattagtggcaatttcatacagtttaactgaaaaggtacctttgatgtattatatcaagtcacctggtatgaattactgtctatcccacacttgacattatcagaatcaaatccagaccggctagctatgaatcgcagtgactctttccatgtgaacaatatgcattcgtgctgtgtgcagtgtcctctagatagggcaatgattgtcttctgtaaaaatatgtagatttccccatagtagatattctttatgggaaaataactcaaattgatggcttcagagtgactggaattcatcaagcattgtttatgcgcagttagaaaagaaattgcttgcattcaatgatgtgattttgaatattatgtcccactttattgtctataaataccgacaataaagggagataaagtaattttaagaataaatggatgaggagtgtggggcaaaggaaaaatgctagtagaaagaggatatcaaaccaataatgaatataacaaggatgatgcacaaaatgtgtatcataagattctgtgaatttcttgaagtaggccacaacttctggctctaagcttgtaatagccaatgtagaaaggaacactgcattaaccgtgaaatttgcagtgcccattaggcaacagaaaccagttgtaaatgagaagcaccatgatttctggttctagagccagaaagaaaattcaccagtgggccttcataaaaaagacactgtaactgtgttgaattacaacttattaacatctttacaataaacaccataatgaattttataaggaagctttttctttaagcaattttcttatacataggccactagtagaaatatcaaagtgtaattcagtaaagggtaataagtggcggttgatatgatatggtacagatttataggtctcactaagctggataacccaaggatagacttcgaaatggatgtactaaatgaatggaggtacagctattccctcaggcaatcctcctctgagctttgatagaggcagagagttccgttatatcccctgacacaagtatctggagtacagctcttctgcttactgcttaggtgcagttcaatgcagagacacaatttccaaccatcattgcggtgaggataggataagcatcctcaaatggaaattgaaaggcttgacaggacataatcttgaataaaatattatcccacttctacaggggatccaggcctaactagatgcagggcaaagaaaaagtttatctaggcactgataaaggaaaatcaaaagtccttaaatctgtttgctggcttgtaacccatagcaaaaatctgaagcagatgtaagaaagacccagtgttaacaataacgccatctctttaaaaaagcaattttgctttctagtatttccttcaagaaaaaaataattaccaagtttctgtctatagatcaaaatgcgttaatttgaagtagtaataataatgatgcagaggatgacgaggatgatagatgattactatatgtgagacactattctaagtgttttacatttatttacttatgagaccctcactataatcctatgaggtaagcactattattatataatatggacgtacaaagagcttaaataattttcttaaggaatatagctagtaaacgtcataatcaggattgtgaatcagtctggctccagaaccagtgatcttaaccactgtgctatacagtatagggttactacttgtaagccagttttatgctagagaaaagctatctcacctctaaacgattattggttttagaaaatgtgcctctcttttaaatagtgattcagtcttatagctaatggtctattaaggttactcatatttaatgacaataaaactgcacttcacatgtatgataatgtttttgttggccgggcgcggtggctcacgcctgtaatcccagcactttgggaggccgaggtgggcggatcacgaggtcaggagatcgagaccatcctggctaacatggtgaaatcccatctctactaaaaaaaaaaaaaaaattagccgggcgtggtggtgggcgcctgtagtcccagctactcgggaggctgaggcggcagaatggcgtgaacccgggaggtggagcttgcagtgagccgagatcgtgccactgcactccagcctgggcgacagagcgaaactctgtctcaaaaaaaaaaaaaaaagtttttgtttcccttttctatgacaggaaggtatccatacatttattcattgaaccaatgtttactgagtgtcttctatgtcttaggcattattctaaatgctgaaaatagagaaatgaacagcacaaacactattcctgctgtcacaaagtttacactttaatggaaggagaaaaattatataccaaaaaataaataagaaaatatcaaagagcaataagcactatgcagagaattaaaacagggttatgtgaaagagaataactgggtaataatgttatttagatcaccaggttttgtttggattccgagatttatatatctagcccaaaattttcccctgagaaacaaatttgcattgatctttctacgtgacgtctctaatcataacactcaggtatgcttgtttttccttcatatgctcttaaaatgacaaaatacatgtttttataacatcagagtacacgtgtctgaatagtaggagctccatgatcttgaattgattgaatagatgtgttcatataaatttcctaaaactacttaggggaaagatattaacagaataggtgacacataatgtgttcagtaaatgtttattgaataagtaaataaactgactcagtaataaacccaagcgtcaataaatacgattacagactaatctgtactcttgcaaaatgcctttctctgatagccagagagatgaaagacctaaaacttgtatatttaggaatatatcacaaagcctaggaagtaaataattaaaataatcagaaagcaaacatattgttaggcttctgcttctatccataagagaataaatggaaccctgccataagaacaactataaaatttaacaaattatataaagcagctgtttttagtcattggccaacaagccagaagaccgtgattacagttgtgaactgagcttcaaaattgcctccatctgctactgggagctctttcttgccacagagggaggtgaagacaagaatagtgtcaggtgtagctgagcaaaggagtcagaaatctaagtgctgggctaggaattggctggaaattttaggacaaggtacagagaaggggaatctacactggagggaaaggacagagtccaagagtctcagtgtggatacaccatgaatccttggccagagtttggctgaatacatgtggggtgataccctggagtctagcagaggtcctgtggtgtgagtttgagaactgaaaggtgatagtataggtagcacagtgctgagtgatgctgagctccagccctgtgagagtgaagaatacttgttgagcacctcaggtctcagaaagactatggtcccagaaggtccacactgtcacagtgcagttcaaacttaaaaagagctagctctaatgcaaataaaatcaaacctgaaaagatcagtaggatctgccaataattaaactgtttgacagaacaaaacttaacaccttataaaggaagatgacataatcgaggttctctacaatatactgttcacaaagttcaaaatataataaaaagttactacacatgaaaaaaggagaagaaaaagacccattattgacggagggaaaaaggcagtcagaagaaacgtatcatgagatggcctagatataagaatcagcagacgaggactttaatcccagcactctgggaggctgaggcaggaggatcacttgagcccaggaatttgagaccagcctgagcaaaataatgagacccgcctccaaaaaaaaaaattaatttgctgggcatggtggctggtgcctgtagtcccaggtattcaggaggctgaggtgggaggatcactgagcctaggaggttgaggcttcagtgagctatgattgcgccactgcactgcagcctgggcagcaagtgagaccctgtccccccaaaaagaaactactaaacatatgttcaaagacataaaggaaaagagtgtcttggggagtgaacatatgcgagtatgaagagaaaaacagacattataaggatgtggaaattcaagaatgtacaaactctgcaataaaaactcactgagtgggcttaataattgaggattgcaaaaggaaggctaagtgatattgaagacaagtcaatagaaattattggatctgagtagaataaagcattgttgatcttgaggacaaatcaatagaaatagatctaaagagagaagattggagggaaaacaaagtaaacacaaggtgggactcatgcctgtaatcccaacactttgggaggccaaggtggggacactgcttgagcccaggagtttgataccagcctgggcaacatagtgagatgccatttctattaaaagtaaaagtgaacagagattcagtgattaatggaatagtgtcatggtgtctaataaatgtattaatgatattccagagaaagaagggaatgatctgacagaaaacatatttgaagaaataatggccaaaaaaaaaatctcaaattcagttaaaaaaacatcaacttaaagatccacaaagctcagcaaaccaccagcagaataaatacaaagaggacaacagcaaaaataccctatactcaaatttctgaaagataaagagaaaattttaaagcagccagaggaaaaaaaaaagatacaatacatacatgtgaataaagataacgaacgagggttgaaatctcagacaatgaagtctgcaagacaatgaaatagtgtttgctgagaaaaactgaacgactacatttggtgaaaatagtcttcaaaagtgagcatgacaaacggacatcttcagagaaatggtaactgagagaagtggttactgagcagttgtgaacatagactatggagatagattacctgagccatgtgatcttggacaggttacttaacttctttagaaaaatggtaataatagaatttttaaaaatttaaaatagtccatatactgcacttagaacaaggccaggcacatactaagctctcaacaaatctgatctaaaatataaggcacggccaatgatttagcaagaagtatgagatgaaattcagcagtagctcaacaggggaaaacatgcccacaattacagcttagaacttggggaatgagtaagtaaatgagaacatcatgttcctcagaataacatcgtaatttcctttcagaaaataaatcaaggatctgtggaacctccaccatctcctcagttccagagagcctcatatagtggaaccaaaacttatggtctggaagagaaatcagcttcccttctcatatttgtgccttcccatatctgtttggtgccagctaatgtaataccagtcctgaccaactgatgtgtcctcccaactaaaatgcagctgagcccattgaaaaccattctcctaactagagaaaggagcaagaaaatcacagccaagaaggtccagccaagaagtgctgggagtcctctgaggacttcatcaagaatggagacagaaataaccccaaaataagaatacaagaattaaatggaatacatatgataccacataccttgttttggatctacctctaaatatcctctcaagagttcttttcacatttcatgccaactggtcccccatcaaggggaaaatagaggcttaaatccctctccacccctacccactgctgtctccctacagtctctcctggctgggtagcaatgctgacattttttcctgcatgttcaatggttctttgtgtccaattaaaaggattttaaaacaggtagttctttatgtaaactttgaatgatgtaaaatattaaaaagcaaggccatttttattattgacacataataattgagtgtatttatgtggtactgtgatgttttgatacatgcatacaatgtataatgatcaaaacagggtatttaggatatttgtcatctcagacatttatcatttctttgtgttgggaacgtttcaaatcttctcttccagctattttgaaatataccatcaattattaactaaagtcacccaactgtgctattgaaaacttgaacttactcctgtgtatttgccccattaaccatcctcttctcatccccctctttccactacccttctctgtctctggtaactatcattctactttctacctccatgagatcaactctttttagctcccaccatatgagtgagaacatgtgttatttgtccttctgtgcctggcttatttcacttaacataatgacctccagtttcttttttcttttcttttcttttctttctttttttcttttttcaagatcttgctctgccacctaggctggagtgtggtggcagggtcacagctcactgtagcctcaacctcctgggtgaagcaatcctcccaactcagtctcctgagtagctgggactacaggcatacactaccatgcctagttaatttttgtactttttgtagagagggggttttgccatgtttcccaggctggtctccaactcctaggctcaagtgatctacccacctcagcctcccaaagtgctgggattacaatgtgagtcactgtgcccagcctagtttcatccatgtagctgcaaatgacataatttcatttctttgtatggatgaatagtataccattgtgtacatgtaccaaatattatttatccattcatttgttgatggacacctaggttaattccaaatcttggctataaatagtgaatagtgctgccataaacatggggatgcaggtatccctttgatacactgattttctttccttcagatagatgctcaatagtaggattgctagattgtatggtagttgtttgtaattttttgagaaaccacaacactgttgtccaaagtcactaatttacattcctaccaacagggaactcttgttcacttttctcttcattcttatcagcatttcttatgttttctcaatttaatagtagccattctaactggatgagatgatctctcattgtgattttgatttgcgttaccctgatgagtagtgatgtcaagcatttttttcatgtatctgttggccatttgtatgtattcttttaagaaatgtctattcagaccctttgcccactttttaatggaattattattattattattgcagttgagttccttgtatattctagacgttagtgccttgttggatgaatagtttgcaaatattttctcccatatcagaggttgtctcttcactctgttgattatttcccttactgtgcagaaacattttattctaatgtcccattagtttttgtttctgttacctgtgcttttgaagtcttaaccataaaatctttgcctagaccaatgtcctgaagcatttgcttgctttcttctagtcattttatagtttcaggtcttatgtttaagttcttaattcattttgtgttgatttttgtgtgtggtgagagataggagtgtagggtttgtttttttttttgtagctattgtaaacgggattgctttcttgatttctttttcaataagtacattttgatgtatagaaaagccatcaatttttgtatattaattttgtatcttgcaactttactgaaattttatttttatcagttctaagagttttattggtggaaacttcaggcttttctatatatacaatcatgccatctgaaaagagggacagtttgacttcctctttcccaatacggataccttttatttttccccttgcctgattggtctggctatttccaatattctatggaataagaatggtgacagtagtcatctttaccttgttccagattttggttttttttttttttttttttttttttttttgagacggagtttcactctgtcactcaggttggagtgcagtggcgtgatctcggctcactgcaagctctgcctcccaggttcacgccattctcctgcctcagcttcccaaatagctgggactacaggcacctgccaccacacctggccaattttttgtatttttagtagagacggggtttcaccatgttagccaggatggtctcgatctcctgacctcgtgatccgcctgcctcggcctccagagtcttgttccagtttttaaggaaaagaaactcattccattttaagtgatatttgaaaatactcagtgacactacagagatatgcagaaggtcagcagagtgaagaactccccatcccacatacgttgctgtgggttctctcattgtttctgtccagaggagaaaacaatctgaaatgtctgagaacagtgaacttaataataatacaacagataaggactaaagttgttgaattgcaaataaagttttaacgaaaagtaattaggtaattagtatgatacttaaaatactatttaaattcacgaaagaataacgataggaaaataacaagattttgagtgactatagtagattagaagtcaacaaaaacataaatgtaaaaagcatagtgctgagattagagttcaaataggtgagataaaatgtaaggactcattaatagtaattaccaaaaaaattaggtgagatagtttaaaatctataaggagaacattttttaagtaaaggaagagcttaaagatttgagggagagaaaaggaaaagaagagaacgagactgggagacgtggagtgagctagggtcaaaatatgcaaaactggtctgacttgtggtgaatcccaagttgaggtaacagggtccatatacagctgtggtttgcaatcttatctcttcactggaattacccaaggagctcttaaatatcctgcagctcaggccttacctgaaaacagttaccctaaatcagatgtcagggtgagaaatccagctatcggtagttttaaaccctctccaggtgattccagttatggcccagggtgagaattattgctctatttggaatgaacatcaagaatgcagaaagcaataaaatttcttcctggagtaagtggaatgatatggttaggcttcgtgtccccacctaaatctcatcttgaactgtaatccccctaatctccatatatgaaggaagaaaccaggtggaggtaattgaatcatgacggcggtttttttctgtgctgttctcgtgacagtgagtgagttctcacgagatttgatggttttataaggggctcttccccctttactctgcacttgtcttttctgctgccttgagggggaagtgtcttgcttcctcttcaccttccaccatgatttttaagtttccagaggcctccacagccatgctgaactgtgagtcaattaaacctcttcctttataaattacccagtctcgggcagtactttatagcagtatgaaaaaggaataatacatgggatattgggccctaaaggattattagcttttacttagtaagttaggactggagggagatacttaaaaacaaacctagagctggtccttagagataaacaggaacaacaactttaggaaactttgttggtcagtcccccccccactctcccacagctggatccactttgcctgagatgcggttttatcagctcacaaaagagttaagatgatcactaatatcaaacatttagaaggatttcctagcaagatttgagattttcaatgacaaatatttttgaatttctggtgtcactcttctaagcagttttatttaaaagaatataggcagtgtaaacttgagaaaagtattccaactcagcttatatgttggcacaagtaaaaacggggacatagactttctgaaatatccaggaatatatcacgagtagagaaaataaaataccattgaaaaaattattctgcatattcttatggtcaaagacaataatagcaagcaattgtttatcagagtgcatgcagctctgttctggaatgtacatggcatctctaataggtatgcatgtagtaccatggtactttggagcaccttgtggttaacttttgctgtactccttcatagctgtgttcctcaaagggtgatctaaacattactgcatcagattcacataaagtacgtgttaaaaatccatatccctagtttatatttctggatttcaacccaaatgtagtgaatcggaatttctgagaatagaacccaggaatctgcttccttaaaacatccctttctgtctctcctacctctctccccaaaccccagtaatggagacatgtactgaaaactgaaaaattactgttctaaggttgagcataggtcatgaaaattatgattatgcatcacagactgggacaccagtgactttgccacattccagaaagctgcataatgatatttttctgtgggcaatgttgacactcagcaacatttgacctttcgtatttgtttttaagaaacacatgcagtagtttaagtaatcccagaagccttactgctatttttttaaggagccttgtcatagatatcatgtgtcttgcgatgagtggggtgaatattagcagccttcatgcttagcctaataaaaggagaacccagaagtactgaaaactccattttttaaatgtcaaacccagcagtttaattcagacctgccaattcagttggcaactgcaggaacaggtggattcgttgtaggtggagtgaagcaaggcaggaatggaggtacaaggaggaggaattggggtgattgctgtcacttgcaattttgtatgtagcaaaggactctgatcaactaaaaagcagtgtgagaaaatagacttatcatggtctaggggttctagaacaagaggaaacgatgtgatgacaaccaagagccagatattgcttgcttagaccaaaatctttggagccatacttgattcttctctctctaacccccacaaccatttccttagaaaattttcctgactctgctttcaatatttatctgaccccttcacttccactatcatcttccagtccaagccactgtttcttgcctgtattattggaatagtctcctaacaggtaaccttgtgttccttgccctgcacaatcaattcttcgcatgacaacagagcatcattttaaatctgaagtctggctgtcactcttgtgtttaagcgacagtctgtggatttttttgtgataaataattatatttggagttgctcagcaaatgtgtggagctgtttgcagaacttttttgattagatactcaaattcttcttcagtacttactttgaaacaaggattatgatttcacaaattctaaatgctacagttttgttattatattttggataacatacatattccagactgcttattttaatttacagtatcagttaatgctgtttttgttgttagggacatcgtgagaatttgagtcaataacggtatgctggaagagttcagtatgagttctatgtacactattctacaacatgtcctatttagaaaaaatggaaagacagactctccatatttgcagtgttgcaacagatggtacatccccatagtagaagagtcatatccccaacaagctgttgatacaatttgtgaaatttaaattctaacaatgatgaaattgttagaaaaatgtatattttgaacaatcccactatttttaagtgttcttatcttacacgaaacaaggtcagtgagagaaattatctgacatatgtttatttctataaataatttaaaaatagcacagttgtattttatttgagtcatgacatgaggagtgattttctaggaaatatggcatcgtgggcatagacatatggacctttctctataattccctaaaatggccagtgaatatacaaatagggaaaaccctatacctgtccttgaaatcaggagacagcccatctagactctagaccctgggaggagtttctgtctgctaagatggtatttatataagactggaggaacagacaccaaggcaaagcagcaacccctgtgagactgagtaatatttgtaagagaattaggaagggaccctggcaaggctcactggcatcctagcttggaagagtgaagactgaaggcaagggcagtcaggacccatcgctcaaatatcctcctaacttgctgacacgcagcattcaggcagcagaccagctgcaaggtgggctcagtcctttatgtagaggagaaggctttcttggagatctgtccctatctgttacaacactgttagtgtccacgtgataactccctcctcaccagcagtgttttcgacacccataattgggaagttaaaactagaatataaagctgaggagaaaagaaaaaggaatgctcttcaggtttcagtctggacctaaaacgtccttttttcaaatatttggaaagaaccttatctaaatttatataatgtatacagtgtatctttcactcgattgtaaaccaaaatagaccaagcctagaccttctctaactccaaaagaataaacagaaaagtcaacaggtttatgtaaaaatgttctaattccaaagacagtgaccgctccaatgaacagcttagctctgaaatagtctagtgtaagaaaaaacactttttaaaaatatgatttgtgacctcaccacaattcaagagattatccaagcagcaagcatgaacacgtgcaaagaggatgcgatctatgatcaagcaggatggccagggatgaaaataatggctatcaattcatgaactgcacagagtagttgattggatactgaagatattgattatgatatagaaaatgaactcaagtacaattcatgtatgcttcctaaattatataatgtcttggtttaaaagaacaaaagactaatcaaaaaccataactcagtggctgggcatcgtggctcatgcctcttgtcccagcactttggaaggctgaggagggcggatcacctgaggtcaagagtttgaaaccagcctggccaacatggtgaaaccctgtctctactaaaaaaatacaaaaatcagccagacatggtggtgtgtacctgtaatcccagctactcaggaggatgaggcaggagaatctcttgaacccaagaggcggaggttgcagtgagctgagatcacgccactgcactccaacctgggaaacagagggacactccgtctcaaaaataaaaaataaaataaacttaataatgagttatcgtagctaaaaaggactggcagggagctttgaagcgcattaaataccaaaagataattctcaagcattattttaaatatggctcaaaattgattgaggaataaatgtatgagctttgaaaacaatgtgttataaattttttttaagtatgatggggtttatgtcaccattatattaaccaggctgagaaagacaagaggaaataaacttctatgattcaagtttagtacaggaacatctccaaaaagctttgagcaatcactggtaacattgaatttgattaattttcaggataaaagctttctttatttgcttgacgccaattactgcgtgaatttttagtgactctagctaaggtctaagtaagctttgagcaaatcatccatagaaccttcttgaaattaaaactgctttggtaaaatatacctgaaattactaccacacacttgtagtaactcagaaggacaaaacagtaaaaacaaaacatcaaaaacgcaccactagtgccaatggcaccaaaacaccctttggcatgtaatgcctaacataatggcagggagttgcaaagagtaagcacttaatatttattttaacttactgaaaaaaatttaaaaaaaataaaaagggaacagaaagccatttgtaactaattttatttgtcggtctttggaatctcttgttatcaagcatccttatatttagtaataaagttttgtcagttcctatacagaaatgaaggtttaaatccaagagaatttccttgtatttgtgaattagcaatcaaataagttcgtttaaggaaataaaatgctaatttaagaaaaaggtagatttacagggatgacaatggaaaaaaaaatacgtatcaggaggttttgagtgcctgaaatgctcagctgttttgctaaatggatgaatgaattattaaatttattgcatttttctcaacctttgagcaccagtatatcttttgaatgaatacagaaaatgtatatcattattcaaattagtctgaagtagactgtgtgagatctctgattcaaaatagtctgagaattcaaagatatatttttatgatttagaaaaattttaaaaatgtacatttgtacatttgagagccttagaacaaaaatgatttagctttgaaagattagatatttaaaatggatgagaatataaattgctttttaagtaaaatactggggattcattttcagatgaatatctctaccagattctgcactggtccacataaaataaccaaatagtctgttttgaaaacttatatcattctagtcaaactattccctgtactagacttccaggagttgggtgggaactgggggaagaacatgtcttctactaactgccatattaaagtgtagcatagtgggtaagtcagctttgaactgttgctaattaactgtgtgaccttgggaaaattacttaatctttttgagcatcagtttcttatttattttattttattttttgacacagagttgctctgttgcccaagctggaatgcagtgctgtgacctccctcactgcaacctctgcctcccaggttcaagcaattcttgtgcctcagcctcccaagtgtgccaccatgcccggctaatttttgtatttttagtagagttggggttttgccatttggccaggctggccttgaactcctagcctcaagtaatccacccgccttggcctcacaagttgttgggattacaggtctgagccaacacacctggcctcagtttcttaattcttaaatgtggattacagttgtgcctacttcatgagatttctgtgaggactaaaataatttctttagtaaatgccatgtaagtgcttactgttatcagtataagtgcagaatatcccattttaataataatttaattagacaggtagttattggtatctagcagaaggaaaatttagtttccatttctcactgcggcacagaagtcagaataattttcattgatagaccactaggtttgatatgtgattatcttgatagcctcaatcatattatgttactacatgacattatattaacaaccctcattaaatgtatttttaattatgacctatattaaataaatatgcatatgtgtgtgcctgtgtatttagctagacatatattattgaaaccctgtcatgtacccttccaagattacatggagtagtaattagaggtacatacacactgaagactatggagccagactgcttggatgtgaatctgaaatctatactttctcagctatgtaattgagggcaacttcatactcggttgccctatatggggataactggaatacctacctcatgggttttataagaattaaataacttagtatctgttaagtacttggaacagtgtgacatttcctggcatgtagcaaacaccatcatccatttgttattaaataaattacatctccattcacaagtggaaaccctcttctaaacttttgtttgtaattccttgtttttctttatatatttgacttgtcaatgcttttcagccacaaaccaccaggaacacacccgtagttgagcaagttgggtttgttactcagtggagctggggagaatgcaaccatgggcatctcagtaaggatatcagaaatgacattataaataatgtgttagattatttttaaggagtttcaataaatgggctttgcatgggttgcatgctataagggagcaagaataattctacgactgggtatctaaataaaccttatctggaaggcgaaaaaactggaaggagactaaagctataattggtaaagaagcagaactcatttatattagctggtagaaggaaagatttgatatttcagggctctcacagtgaccttgtttttgcttagacaaattttatagtcttattttttgtctcactccatcatagtcacagaatatgtgatgtgctgccctatgaagttgttcatgttaaacaggaaccatgtcataggtgtgagtgccaggccagcccctaaaagcatcaggcctagctgaaagtgtcaggccaggtccctgatattcatgactgctttcctctttctcagacttatgcatttatcccaaaaccttatgatactgcattttcaaaaaaataaaataaagctttatatgaatggtatcattaaaaaatatattcttcggcttgctttttcactttctgatgacatgtatgtggattttatattggtgattatgctctagcttatttccacctctgtatagttttgacataacgttattcaatacctcttctcttttaattggacatgagttgtttctagatacttgctattataaacaatactattatacaataaccattcttataaatatctctcagataaatgtctgatagttttccatgggatatacctagaagtatgcacatcttttcaatcatactagaatattccaaattattttacattttgatcaaaacaacttaaattcccaccagcagtgtctgttttagctgctttatgtcttctccagcacttagtgttatcaaactttaaaatgttttgacaaactagtggatgtgccattttagtttttagtttcctattcagttgataatgtgaccgttagtggttaattttagccttttgcaatcaattcttccatctttttttattctctttcttctactttcttcacttctcctttcttgcctttcttaaaatttattgcaacagttttgttattacactacttcccatgtttcacaagtcatacatccttatcctatacatatatggatttatatatatatatatggatttatatatatgtatatgtatggattaccttaaaattttaaggtggagttgcaaatgaatatagtttgtaattaatgtatttaccttcctaagaatattttactcttataaccctccaccaacttacatagtcttctattttaggtcttctatcttgcaattatttataactgtgtgtattagttttctactgcctccataacaaatttccactaacttcacaccttatcatacagttctgtaagtcagaggtctggcatgcatctctccaagctaaaatcaaggagctgacagggttccatttctttctggaggctctaggggaggagctgtgtgcttgctcattcagagtgttggcagaattcagttccttcgagttcaaagactgagatcttcatctccttcctgattgtgagctggagactgttcccagcttctaggaatcacccacatcccttggctcctggcctctttccccaaagccagcaatggcatatcaagtaccttttatgcttggatatctctccactcctttttcttccatctcatctttctaacgcactcgagaagcttctctccttttaagtaataatgtaagtagattgggtccacctggatattctaggttactttccccatctcaagttttaaacctttaatcacatctgtggagtcccttttgctaagtaagataacacattcacaggttccaaggattaaggcatagaacttttgagtgaccattctgcctttcacacttttccaattattattttacaatcaatgcttaattttactcctatttgatattttctctgaccactattctctctgaaattttagaccctagttttgtgatcactttcttttttatgagacataagttctttagaaatttctttaattatggtctagtatagtaatactttcattttctgtctgaaaatggtttcctttgcccctaataattaaagatccctggatatgcaattctaggtttcccagtagcccattaaaacagaaagttctgtgacttgggattagtagttcaccaggagagaggccagatttaggactgtggtactatagtagatcggatttatgttgtagattttggggatcctctgaggatttttcttattatcccagttgtataataaaaggctttatttttaaaataagacacagacttttactttcaaaaagataaaggagatgtactttttcctgtagttgccactaaattaaaaaatattccctggaagttgtatagaaaacaaaccataaaaagactttgaaagttggagagaagaaggcagataagctagatatgtcaaggcccaaaatgacaaggtgattagttcccttggttttctttttgcctcccacatctcaaggttggagctaaagaagccaacaacacggaaacatcagtggacacagatttgtaaaaaccctaacaaattcctgctctttctagccaaaggacaaataaaagaccaacttagcaagacacaaaattttagacaataaccactctacccagccaaaaacacacaaaaataacatggccataccctcacccatatcagcaaagtcgtgatgggaacctcagttttcacccttgtgatactgtaatgagtcgctcaacactcccactaggtggtgttagagaaggccaagtagggaactgacacttccatcactgctagttgctatctggtaaagcactccccacccccacaatgttagtgaagacaattaggcaaccagtacacacagccacataaaagtaactagaagttcctctttgttatcaatggaggttaaataagaaacctggacttctgccttcaccttgcagtaacaatgtggcatacatacacccttttgccattctggagcagggtcataaaaagccagttagaaagaagaaaaggattttaaaagatctagagtcttgtgacatgaggcaaaaatgtctgggtttcaatcaaagtcactccttatgccaagaaccagggagttaccagattcaacgaaaaaaataaataaatagcagccaacactgagatgatgaagatgttagaattatccaacaagatataaggaagccatgatgaaaatctttcaacagttatgagcatgtttgaaacaaatagaaatcttcagcaaattaattgaagatgtaaaaaagaaccaagtagaaactgcagatctgaaaaatgcaataacagatataaaaactctgtatacgggtctaacagcataatggaggggagagaggaaagaatcaaagaactaaaatacagaataatcaaaattacctaatccgaacaacacagaaaaaaatatgagggaagaaaactaaaagtatttcagagacctgtgggactgtaacaaaagatctaacattcatgtcattggaattccagaagaagaggagaaagagggcagagcttaaaagaaaaaaaatgtattcagagaaataatggctgaacacttctcatatgttgtaagaagcataaacctacagattcaagaagctggatgaattccaaataagttaaacctgaagaaatacatgccaagacatattataataaaaatctgaaaacgaaagataaaagtatttgaaagcatccagagaaaattgataaccttactacaagaaaaagaaatttgagtgacagtgaaccagaaaccatataggtcagaataaagtactaccatatttttcaagtgctagaggaaaagaactgtcaacttgcaattcaatactcagagaaaatatctttcaagaatgaaggaaaaataatgacattcttaatgaaggaaaactaagagaagttgttaccagtagacttaccctaaaagaatagctaaagaaagttcactaaataaaaacgaaagattaaaggaagaaaccttggaatatcaggaaaggagaaagagcgggtaaacaaagtatagctaaatacaataggcttttcttcacttgagttttctaaattatatttgacagttgaaacaaaaattataacactgctacctgatatgattctaaaaatacgtagacgatatatttaaaacaatttattacaaatgagggagggtaagatttctatactttagttgaactagcaaaatgaaaatatcagtaggctgtgataagatatatatatatagtatatcttgtatatatatgtacatatatacacatatacacatacacacccatatatatgacatatatatgtaatgtaatatctacagcaaacactaaaagagctatagaaggacatgcactcaaaaacactgtagataaatcaaaatggtattctaaaatgtgttaactcacaggaagacagggaaaatgaaacagaaatgaataaataaaaataaatagaagacttagtccataacatataaataactacattaaatgtaaatagtctaagtatactaattaaaacacagattggtagagcagatttaagaagcaggacccaactattcacattctacaagaaactcacttcaaatataatgttatatgcaggtttaaagtaaaataatgagaaactgtgtgtcatgaaaatgttattcaatggaagcaggagtggctatgataacatcgaataaattaggcatcaaagcaaagaaaattaccagagacagagaaagatattatataattatataatgacaaaagagtcaatccaccaagaaggcaaaggaattctatgtgtttgtgccaaacaacagactgcaaaatatatgaacaaaaactgatagaactgaaaggagaaatagacaaaactgtaattgacaaatagataattgtagttggaaatgacaataccttactcccaacacttcatagaataattaggacgaaaatcagcaaaaatacggaagaactcagtaccatcaaccaataaaatctaaaagggattattataattactccatccaacaacagcagaattcaccttctttcaagtgaaacatataccaaaatagaccatgtcatcatccataaaacatagttcaacaaatgtaaaataatttatagagtgttctctgagcacaatggaatcaaattagaattcaatcaaaaaagataggagtaaaatctccaaacacttggaaaacaacacacttctaaacaatcaatgtgtgaaagaggaattctcaaggaaaatcaaaatactggatgaaaagaaaatatatcaaaatctgtgaggcatagctaaagcagtgctgagatagacatttgtaacaccaaatgcttacattggaaaagaggataagacacaaatcaataatcaaagctcccatctagagaaccaagaaaaatgggagtgaaatgagttgaaagcaagaaggaaagaagtaaataataaacataagaacagaaatcaatgaaattgaaaataaaaaatagagaaaaaccaataaaacaaacagctggttcattcaatagatcattaaacctctagcaagggtgataaaagaaaaaagaaaaaacacaaatcaccaacaccaggaatgaaatagggaaatgtcactacacactttacagacatcaaaaggatagccatggaatacctcagacaacctgatacacataaatttgacaacttagactacatgggaagaataaaaaaatcaaaataaattgcaacctaccacaactcatctaatatgaaatagagcatttctacacagaaaaaaagaggcaacaaaggcactgacagttcaccaaaaagaaaaatacagaccaaaatgcctcatacatagacaaaaatccctaacagatattagcaagtagaattcagcaatatataaaaataattaaaatataagaccaaatgcagtttattcaaggatgcaagcctactccaatattaaaaagttagtcaatgtaattcaccaatttaacagactaaaaacataatcaatacagcaaaagctatttaacaaaatttagcatccattcataataaactctcagaaaaaaataggaatagagaagaacatcctcatcttaataacacctaggaaaacctatagctaacattatacttaatggtaaaagactgaatgcttgttccctaacactggaacaaatggtctactggcaatccttggtgttccttggcttgtagctgcatcattccaaactctgtcttcgttaagcatggtacttctctgtatgccttcacatggccttctcataaggacaccacccattggatttagggctcaccttaatccggtaagacctcatcaactaattacgtttgcaaaggccttatttctgaataaggatatattctgagattctggtagacattaagtttgcaggaacactatacaaccaaagtacattgattgtaataatatcaatattctggctgtaatattgtactatgtttatacaatcttgcctatgggagaaactggataaagtatatgtagaagctgtcaaattacaatttcatatcaatctacaattacctcaaaacatttaatttaaaaattatagatataatttataagatatataaactatctttagaggttatatagtatgtgtatcttcagaatacttcattggccatcttgatagaaaaagaagtgttgagattatttttatttttttccatttgtagagcttaaacattcaaaacacaagaatatttcggaaccataaacattcaaaacaagaatatttcagaaccacagaaatgcatcagcctcattttttaaatttgttttggaaacttcagaaagtttagacattcttttgtgaccttgtgaagcatggaatatacattcatttgaatcctctttaaattaagaacaataaaatttctccattattctgagaaatcaaaaagaagtcttcttaaagtttaatatgtatttctctggagtttgtattggctgaagaaccatttcttaaatagtaaattatacaagagtaagaactgggccattctagaaaatagaaatctcagtataaactgaaatccagtaatttttcctaggtctgtcctttacttcattcactgaattacactgattccaaataactcttgggcaattgcagaaatgtaatcgtcttacagtttttgaggaactcaggtaagatctgtgatttacaattaatatgtactctatttcaagaaaacctataatgaaaatcaccaaaggaatagaattatacatagcaggtattcttccctgtttccttgattaatgaaaaaaagcttatgtatacatagggacaactgttaagtagaaatcattctttgacaattatgtcagtgttgatttggtgcgcttagcagctgagcaaacctcaagaaggctttgtttcagcaatactgaagcagctatgttgtctggggtatataccctgggatttgtctcgtgccaggaaaatttaggacacagacacaaatgcagagttttggagtggagattcaataggcagaagagaagagaaagagaaacatctccctctctagagagagagaagggtgtctgagcagaaaagacccgagggagggggatgtgctggattttatagtcaggtttgaggaggcggtgtctgatttacataggactcacagattggtttgattaggtatgatgtttacatagcttatgggaaggctggctgctcagccctaatcttattatgcaaatgaactctcctgttgatcggtaccatcttgtctgttccttactgtacacgtatgtggctcataaagacaagggaaggtggggttgccattttaaacatgattggcacaactaccagcttctatgactgcagctcaattttacaggctgttctttgttaaaaaggaaaatgatgtggggctgcttttcattaaaatggaaaccttaccaaggacttctgtaccctcactatctgcctaagtaattttttcttaactcctgtatcaatacttccttgagcctttatttatcacatttccctttttgtagctcaaaattttgtggctgattattctatttaatttattgaaaatacaccaaaagctaaaataaaacttattttttaaaaaacggccacgaagtaaaagcacaatgttttaacctgtttcctttttttacttgtttaaattaggggttgggagtgtgtgtgtattttttttctaacttttaagttcagggatatatgtacaggtttgttacatgggtaaatggggagtcatgggggttagtgtatagatttcatcacccaggtaatgagcatagtactcaataggtcgtttttcaatcctcaatcctcaccctcttcccaccttacaccctcaggtaggccctgatgtctgtttttccctactttgtgttcatgtttatcagcttccacttgtaagtgagaacatgcagtatttggttttctgttcctgcagtaatttgaataaggataatggcctccaggtccatccatgttgctgcaaaggacatgatttctttctttttttgtaccacattttctttatccagttcactgttgatgggcatctaggttgattccatgtttttgctgttttgaatagttctgtgatgaacatatgcatgcatatgtctttatggtaaactgatgtattttcctttgggtatatacccagtagtaggatggctgggtcaaatggtagttgttttaagttctttgagaaatctccagaatgctttccacagtggctgaactaatttacattcccactggcagtgtataagtgttctcttttcttagaaaccttgccagcttctgttattttttgactttttaatagtagccattctgactggtgtgagatggttatctcatggttttgatttgattgtctctgatgaatagtgatgttgagcaatttttcatatgtttgttggccatgtgtatgtcttcttttgaaaaatgtctattcatgtattatagtttgcccattctttaatggggttgtttattttttgttaatttgtttaagttccttatagattcaggatattagacctttgtcagatgcatactttgcaatattttctctcactttgtaagttatctgtttactcagtggatagtttcttttgctgtgcagaagtagctctttagtttaattaggtctcatttgtcaatttttctttttgtggcaaatgattttggggtcttcgtcatgaaatctttgctggggcctatgtccagaatggtatttcctaggttttcttctagagttttatagtattagattttacatttaagtctttactccatcttgagttgattttcatatatggtgaaaggaaggggtagagtttcaattttcagcatatgactagccagttatcctaggataacttattgaatcaggagtcctttccgtattggtttttgttgacctttttgaagatcagatggctataagtgtgtgactttgtttctggaatcactaatctgttccattgatttatgtgtctgtttttgaatcagtaccgtgctgttttggttactacagccttgtagtacagtttgaagtggggagtgtgatgcctctggctttgttctttttgcttagggttgctttggctattcaggctacttttcagttccatattaatttcagaagagttattctaattctgtgaaaaatgtcattggtggtttgataggaatagaactggatctgtaaattgttttgggcagaatggccacttcaataatattacttcttcctatctgaattagttcattttcacattgatataaagaactacttgggactgggtaatttttaaagaaatgaggtttaatagactcacagttccacatcgctgggaaggcctcaagaaacttacaatcatggcagaaggcaaaggagaagcaagcaccttcttcacaagatggcaggaaagagagagcaaagggaaaagtgtcacttcgaaaccaccagatattgtgagaactcactatcatgagaatagcatgggggaagtgcccccatgatccactcgcctcctgccaggtccctcccttgacatgtgggattacaatttgagatgagatttgggtggggacacagaaaaaaaccatgtcactattcaagagcatagaatgtttttccatttatttgtgtcacttctggtttctttgagcagtgttttgtaactctcattctagagatctttcactccctggttagctgtgttcctaggtattttattctcttggtggctattgtgaatgggattgcattcctgatttggctttcatcttggatgttattggtgtatggatattctgctgaatttcatacattgattttgtatcctgatagtttgctgaagtgtcttatcaggtctgggagcctttgggcagagattacggggttttctaggtataaaagcatatcatctgtgaagagagatagttttaccttatctcttcctatttggatgccttttatttctttctcttgcctgatttcactggctagaacttccagtactattttgaataggagtggtgagagtgggcattcatttgtttgttttaagttctggggtacatgtgtaggatgtgcaggttcattacataggcaaatgtgtgccatggtgatttgctgcacctgtcaacccatcacctaggtatcaagcccaacatatattagatatttttcctgatgctccccccaaccacactcccccaacaggccctagtgtatgttgttcccctccctgtgtcctcattgttcagcttctacttataagtgaaaacatgaagtaattggttttcttttcctgtgttagtttgctgagaataatggcttccagctccatccatgtcccttcaaagacatgatctcattccttttaatggctacatagtattccataatgtatacgtatgagattttctttatccagtctatcattgatgggcatttgggttgattccatgtctttgctattgtgaatagtgctgcaatgaacatgagcatgcatatatctttataataggatgatttatattcatctgggtatatacccagtaaagggattgttgggtcaaatggtatttctagttctaaatctctgaggaatcaccacactgtcttccacaatggctgaactaatttacttttcacaaacagtgaaatgtaatttgtgtaatttacattacacaaacagtgtaaaagcattcctatttctccacaaccttgccagcatgtattgtttcttgactttttagtaatagccattctgactgacatgagatgatatctcattgtggttttaatttgcgtttctctaatgatcagtgatgttaaacttttgttatgtttgttggctgcatgagtgtcttcttttgagaagtgtcttttcatgccctttcccactttttaatggggttttttttcttttaaatttaagttccttgtagattctggatattagacctttgtcagatggatagattgcaaaacttttctcctattgtgtaggttgtctgttcactcaagtgggtattcttgtcttgttccagttctcaaggtgaatacttacagcttttgtccatttggtataatattggttgtgtgtttgtcatagatggcttttttttttaggtattttcctctgacacatagtttgttgatggtttttaacatgaagtgatgctgagtcaaaagacttttctgcgtctattgagataatcatgtgatttttgtttttagttgtttatatgatgaatcatatttatttgtgtatattgaaccaaccttttgtcccaggaataaagccaacttgattgtggtggttcagctttctgatgtgttactggatttggttagcttgtaatttttgaggatttttgcatctatgttcatcagggatattggcctaaagttttcttttttgttgttgtgtctctgccaggttttggtatcggaatgatgctagcctcatagaatgagttaaggagggtttctttcttaattttttggaatagttttagtaggatcagtactagctcttctttatatatatatggtagaattcaactgtgagtctgtctactccaagcccttttgtggttggtaagggttttttattactgtttcaactttagaacttgttatgtgtctgttcagggtttcagttttttcctggttcaatttttggaggttgtatatttttaggaatttatccatttcttataagttttctaggttgtgtgcatagaggtatcataatagtctctgagggtattttgtatttctgtggggtcactggttatgtcacctttgtcatttcttactgtgtttaataggatcttctctcttttttctttattagtctagctagcaatctatcaatcttatttattctgtcaagccagcttttagtttggtcattgttttgcttgtgggtttttattacactgttttggaaagcacagctttgtttttggttatttcttgtctactgctggctttggtgtcactttcctcttgtttttctagttcctctaagtgtgatttcatgttgttaatttgagaattttctaattttttgatgtgagcatttagtattgtaaactttcttaacactgctttagctgtgtcccagaaagtctggtatgttgtatgtttgttttcattaatttcaaagaatttctttatttgtgcctaaatctcattgattacccaaaagtcattcagaagaaggttgctttaatttccatgtaattgtatgcttttgagagatcatcttagtattaacttctgtatttattgtgctgtggtctgagagggtggttgatatgatttggttttttatttttatttttttgaatttgttaagaattgctttatgttcaagcatatggtcaattttagagtatgtgctgtgcacagatgagaagaatgtatattctgttgttgttagatggaatgttctgtggaggtctgctagtttcatttgatcaagcgtgaagtttaggtcccagatatctgttagttttctccatccttttactttgagcctatgagcgtcattgcatgtgatatggtctcttaagatagcgtacagttgggttttgtttctttatccaacttatcactctgtgccttttaagtggagtgtttagcctatttatattcaaggttaatattgatatgtgaagattttattctgtcattatattggctagttgttgtctagatttgtttttgtagttgctttatagtgtcaataatctgtgtacttaagtgtgtttttgtggtggtcagtaacagtctttcatttccatgtttagcactcccttaaggacctcttgtaaggcaggtctggtggtaatgaatttccttactccctttcagagatgccagtgagtcataggtttagtctcttcacataatcccatatttcacataattccttatttcacttttttaatttgtttacattatttttgtctgtctgatttgatttgaagaaccactcttcaagctctgaaatttcttcattagcttggtctattctgctgttaatactttcaattgtgttatgaaattcttatagtgagtttttcagatctattagatcagtttgttttttttcttaaaaaagctatttcatctttttactggattccttagatttcttggatcgggtttcaactttctcctgaatctcagtgatcttcattgccatccagactctgaattccatctctgtcattttagccttttcagcctggtttaaaaccagtgctggggaactagtgcagtcatttgaatgtaataaggcactgtggctttttaagttctcacagttcttgtgctggtttttctctcatctgtatgggctgatgttccttaaatctttgaaactgctgtctgttgaatgtggcttattgcttttatattctttgatgtccttgagggtttgacagtgttataaattgggttcagtcaactggcttcatttccgggtgatttcaggtggcccaggctcagctcagtacactggggacctgggaccaggcctatggctttgttctctggcccctcaaggttaagcacctgctgtactgcaagggctgaggtgttcctagtcagctagcagcaacactctgatggagggtgctggcaaaagcactacattggggtggtgacaatggggtccacacttgggcatgcatgccatcaactacagggcagcagtgtggcagggtccacgtgtgtgtgtgtgtgtgtgtgtgtgtgagcgcgcgcccacaccagcaacaacagagcagcaacagggtggtgggccctggcacaatggttggggaaggctgcaggcaggagcatgctggggagggtccatctgcagaagctctctaatggtggtacctaccaatgaaggagctacagtagcagctgctggaaagcaccctcattgggcatctgagattgtactgcaagtgtacaaggccaggcagttaccctgggacgggctggaagatagggggtgctgagatcagactgggcttgtgccatggggaagaaagctatgctctgttcatgtcctacagtcaacaaaggccaaagccatcttgaagagtgtggtgagccttgggagaaggacatctttggccatgctcttctgcagctatttctgtgccaaacgctctggattctgcacatattagagacctgcccctgataactctccaataagctctctctgcaaactcaaatgtctgttgaggagtgggttcccctgcagctaggattctggggtccatggcaagagtgggccattccatgcctgtttaattcacccctttcccaggagcccctcagggccaggaatggatcttgatgctcagtagcccagtgcagagttcccagcttcctcttcttttagcccaggttctatgttctccctctgtccaccttcaatgccatccttctgaagatctgcttggagggtgcaggtcttcttaatggtctggtcacttggtgggagaagctcttcctgtcagccatcttgcttaacctgttttcttaataaaacaatgtttgcttcctaaagttttcaactttatatataaaataaattcagactctaataagattcctcacaatttcatacccagtaaattttattttatataaattattatttcaaaaacaatatagtagcaccaagatttaaaatgacttttcatcaattgaaggaaaaaatggagattttaaggtcttctacccaaaacctctcattttaaattagatactccgaaagtttccataagtaaaaatcattacttatgttaatttgcagctaatttgctacatagtatagactcttctgcctatacatgtctttaaaagaatccatttttatatgaaatgtgtatcattggtgtcaagttttttatattcagagagtgaagcttttaatttctatattttatgtcattagtgtgctgaacacttctgctcctggaaagcaatgaaattaatcatttttggcttcggctgctgttgtgatgcacataaacagcaatcctgttgaactcgagtgagaatgctcactgtgctcatactaagccaattagtgcccagttatttattttcactgtagtggcgagtgtgggagtggtgggggtggggaggcgggggagatgtggagagagagataagcactactagtagagaaaagcagacataaaattggcagaatatttttcagaacaaaaactgtggtagtaagaggaatcaatgtcataggctttagatagcatttatgactgtgtgctcgtgtgtgtgaaaacttataggatgtaaaagtgcttacaatttgtcttcaagtttaaattacaaacagacatagtactttcatttaaaagttaggaaaatgtagtttaaatttttttaatttctctgtgagcttctgcatgcaatcctatgcaattggaatttgatagtcctttcacacaggagaatgagaaatagctaagcatccattatttaagtcattttttctgcaagtgtgggctcacccaatcatgagagtgataaaggaactggaactagctattattcaggaaatgtgtgaccaagaaaatgactttttttttttccgactgtgtctcgctctgttgccaggctggagtgcagtggcatgatttcagctccctgcaacctctgcctcccaggttcaagtgattctcttgcctcagcctcccaagtagctgggactacaggtgtgcaccaccacgcccagctaatttttgtatttttagtagagacggggtttcaccatgctggcctggatggtctctagctcttgacctcgtgatctgcccacctcgtcctcccaaaatgctgggattacaggcatgaaccaccgtgcctggccatgtattagatttttttttaaaacaaaagcaaatatggcatcaggagatagacagacagatattatatagatagatagacagatattatacagctaaacttgattctcttcctctgtccatatagttttacatatcttcatcacttagtcatttttagttagttctatgtccagaactatggatatatattgaccttaactgtcaagtatatacaaaagagccaaactgcaggcataaaaaaaacaaaaaaacaaggacaagcaacatttatccacagtttattggtcaaattatgaacaaatgtagataattataaattagcatccttagtgattactagatttgtgtcacatatgcagataatgtgttattatttagacattttggaaataattcagtgagcactgtagctggggggtacagagagtagcccccatttgagatccttcttcatctcacctgctacctctcaatcccggtgaaccaaaagagatgggagagttctccaccaggaactactcagtggacatttttttcatatatgttgaagctatagtccccctcctatttttgttcagtcctctgaagttttcttttactttcttagaatattgctatagaattttagatctaaccttaaggaatattttgcagactaggaaagttatattcagcattattaattgcatgaccaattaatggtaaaactggtaatcaaacaatttgcaagacatctccagtttcctttgactacactttattgcctcttttatttccattcgttctctttttattctcaggatgtggctgagaagcattggaataatgtcttggtagcacttctttaaggattttccttttccatacacacagaaaaatcatattgttggccatatatgttccttttgttcattttttaatatgtgtctgtatttttctctagcctcaaagccaatggacttaaaattatgcactggacctatccctaatactacacagctgtgccacattccttgtccaactgaatgtgaagtttcaccttggtcagcttggggaccttgtacttatgaaaactgtaatgatcagcaagggaaaaaaggtaggtaacgtgaccatgacatgccttttatacccaccaattgtatcaaatcatgaattatttttaaaatgctcttctgtgttccttgtttgtggtattttccagaatggctaaagactattaatttcaaaagatgaattaaccttctccagtgatagtaccagaagattaaaacagaagaacataggcataaatgcttgttaatttagacaacatgatggagaggatctgagacagtttagtgcaatggttaggatgagctgtggggtcaggcctggattggaaaatctactgtgtcccttactgtttagataagttaactaacatatctaaacctttgtccccttatctgtaaaagggatgtaacaatatctgccatccagattgtctctaagcagtcaatcagataaacataaagcacttagttcagtgcctgacccatacctagtgcccaataataaggctgcttattactttgaagaaaaaaatgtaaaaactgtattactttcatatgcaaatgatagaggaatagaataaatgcaatggttttcttatggtagacgtggtgagctaattttcacatgatctcatgattgaaaacatttttcaattttgtttcaaagaccagtcttctagtgattctagtatgtttacatagcaataaacagacttgttaattttgttacacactctcatgaagggcagcatttaggtgctattaaagcacaaagcaggactttgaatatttcacactggagcccacatggcttatgttcctaattcaaatttccagagggtctaaaatcaactgaacctcaaagagattgtttctctggaaccatccaacttcttagaggttcattttccaaatttaatcatgtgacattgctgaagatttaagaataatagcacttttgtctggtcatcggtatttctaaatagcttgaaatttcactccttctttgaatattctatagctacagactttccaagttgaccaaaatttatctctctctctgttcccaccctactcctctacgccctacaagggagatgggtactatatgacatttctagccttacctttgcagtagtaagctaaaaccaaaggttctcattttttttcattccattcgttaatccactcactcatttaatggatggttcatgacctcacattagctacagtttggggatacaccagtgactcaaaacagaaatgacttctacctccactcttatccaacttttactctgaggttttattcaactttctgaaatactaaacctttgatagtaacaatagatttttccttcccccataattcaggcttcaaactgaggaagcggcgcattaccaatgagcccactggaggctctggggtaaccggaaactgccctcacttactggaagccattccctgtgaagagcctgcctgttatgactggaaagcagtgagactgggaaactgcgagccagataacggaaaggagtgtggtccaggcacgcaagttcaagaggttgtgtgcatcaacagtgatggtaagacagacgtatctattatgtttttatggatgtccaaccctgcatatatgtttttactttctgttaaaatcctgtgtcttctcgcattataactgattctgtttacaaacgtagaaatagctgcttctctctccctccctctctttccctgtctctttctcttttgttctaatgaaatggtggcagtgggaaggatccatgaatagtaacaaaataatgttaaatgtgaaaacagaacagatcatataacataagaattgaattatcattagggcaataattgccaaatttaacaataacaagtaaaggtaacttttttaagtgacttttttaaaaaagtctatagctccagtgttatagaaaatgaaatgtaaacaaaaaagggttgtaagcattgtttgatttgactctaaaagtattttcctttaacctccctgatatcgtgtcttagtgttatcatttaatttccaggctcccaatccacgaggcctaccacagcctagagttcctgaaccgaccttttgctctctagggctccactatttaggaatgtcctagagccactggatagtggctttccgcaagattcttttccccaacctcaggaattaccttggacttttacaactaatatttgtttgataaaatatactgtcttgatgttagctctgatataagatttttaccttccttccaaagagtactgctactgttttggggagaactccttacctctaagtcatccctgagtcacacttgaaaaccacaagactcccccagacatactttaaaacctctggacaagatcatctctaaggttgctctatctcttgaatcctatgactctgcacatcagagaagcatgagtgctaaaccccagggtccaacagttgacagtttatgctgtttacagcatgtgcagaaacaccctggtgcccccttgggggtactggaacatctggtaaccgtcataattctttccatcctattttcttccagtaagcagaattgtttcctcctgtgactcagtcactgttcagtcgtaaagaaagacactctctggtgtgggagactgacagacactgctattactgagaaattagccttttgtctttgtccagggtctaatatagtcatgcgagacagtattaggtaaaatctgaaccagtgcttgagtttgaaatgggaagaaggagatcattgctccagatcttttatgatgaattttatatattctgcttttttgctacgataagcataatctgctgtgatatgtcctctgtttagctcttacttattctataataaagagaggaaaaaaaggaggaagtaacactcagagattggcaagaaagcaaaagaagcatgttctgtttctcttttactcacactttaaatcctagtttggattacacaatactgttaccttctgaattgctgtaaaaacagtcagggtcgtattgaattccctcagtaatagtacttgatcgtttttctcagttcaaataattttgcttgtccttccatagtcctatagaggaattagggtctcaggtattgtgaaaagtatttttgagtgaaacaaaacgctaaaaagttaactttgcatggcacttctgcctcagtgttatgcaatgaaaaaatcagatttagtccacttagtacaatgatcttcctggtatttgtgctaatggaatatattttatatagactaaaggagccagctatttaaaaaatatcagtggcttattttcattttgttaagtgaaacttattttgcaacacaagtaattacctcctagcttgtcttgtgaaaaaacactaaaaaacaagcagaggtatgacttagatgtgtgtagttgtactggcaatgtatgttataacctaaaaagcaaattgataactcacaatacaaatgagctggttttactttgtgtacatcacaaacggaatgaattttaaaaaggtaagtatgcaactgctattaaatttgttattgtcctttacaggacatcttttccaccattaaattttatttcctgacattaattagttgtagtacaacttaatacattagctgtttcagctacatggatgtataaaatcaagaaaattatttttttattatgaatcctagaactcactcaaatttgtatataaactgagacataattgggctgatagaatgaaagaaaaagctggagacttgtaactactgctcccatattatcatgtggtcacctggtaagtgtttagcagctgcaccaaatgttgttttgtaattaaattgggcccagggaattaaagttgattagttgtagactctacctctaggcctgggctgcagctatacattttgttttataattaagttaaagctcgactaggggcatgaagcattagagcctgtgaactgaagaaataataaaaagacttttttgctcccacattcctcacagatttcacaactttgttaatgacctcaaaacacttaaaatctatttgttttctgaaatattctttgtccagactcccagtgatcattaagatttgctgctgctgttcatttttccatttcccttctaaggaggaggcttggggagggttgtaagagaccccaggaggagttttgcatagcttctctgtcagagaagaaaacagagggatgtaagagagtcgcaagacaaaagagagcacaaaagacgattagactctccaaaaagagataaacatttcactgtaatagaacaaatattgctcattacttcatgatcatcggatacacaattccaggtctctgaacacaaacgcaggaacctactccaaagatctgtggtctggggaatgacccaaaacccgccctattttaatttttctgatatttgaatatgtttcatttaaaggtgtaaatctggcaaagcaagtgtattttgtttcctaaattggcttgttagaggctgaacaaaccaggctattggaccggagcaaggggaaaaaagtattattccttacttgagagtgtaaatcaaatattgtttccatatttccttctcctctgccaaaaaaaatgatgctgtctatatttccttatcatgtgtgctatttcagatatcgaatattgacacttttccatgtgactttcgaaaaaaaagtcagttatgttatttttttgtttgtttttgcattattttttaaagcagtacacctcagtggtttcaaatgcctgaacttctatgctatcttccttttcttttccccacattagcaaagttaaccaatgacatgggcataggcaactcactttcctccttgacccagattgttaagaaacccaaacatacttttatggaagtaaatcattgcaactcagcattacccagctattaatgttacagtataagagtaatgaaggtcaccggctagggccatccttgtgtattgtgccattcttgaatgggagtaactctgctatccaaagactctcagcaccatgtcaaaccggctggcttctagtaatgctgaagaaggcctatgtctaagcacatgtggagatgagcactgaggtaagccctaaaagcaagtttttctgcctcttttgggaacatttctacatatcatcaaaagtatcaaaagaactggctttgaaaacacctgggggaagttgactgtgttcggctatttgtgcattgcttataaagaaatacctgaggctgagtaatttatgcaagaggaaaagaggtttaattggctcgcagtcctgcaggctgtacaggaagcatggcgctgtacaggaagcatggcactgttaggtgttcagcctctggtaaggcctcaggaagcttttactcatggtggaaggctaagtgggagcaggcatctcacatgacagagtggagcaacagagggagagaagagagagatgccacacatttttgaacaaccagatctcatgagaactcactcactatcataaggccagcaccaaggagatagtgctaaagcgttcataagaaatctacccctgtgatccaatcacgtcccaccagacgccacctccaacagtggggattacatttcaatataagatttagtggggacacatatccaaactatatcattgactttagtatccagggcactggcttgccatgtgactgcttaatctttctcaactttttaccaccaatttcttccttctgtaataagatatgtttccgcctataagatgaggaaggggaaaacttgagtactatttctttcccaagtagttcttgtcatacttctttgtttccatgtagttagcactaggaggaatatgggggcatatcatttcagtatcttcaggaaaatgtaagaattttgaaaatttataccactggagaataggactcattgtggaaagagatagggaaagataatgccctattttaagtcttatagtacaatttgtatgcaatatataaactgtatgaatactgaattttttttcagacatatattattaaaaagtaacagtgtgaagggggacagaggtaagtgggacaatcggtagaagattgggagcaaagcaagcatgccaggaatagaaaaagagaagttatagaactcatagttgagactaatattttgactgattcagaatattcatagattgttccagaagcataggccaggtcaaggatgaagatgcatcgagcttattaaggatgtgctcccagaagaaaccagtaagaaaagggggaatgaataagcaaaatacagaaaagagaaagggtcttgagctcctaaaaccattcccaggtttagtgattcactaggaggattcaccatacagttgtacctataaccatgacttattaaaacaatagtatgcaaaacaaaatcagcaaaaggaaagtgtacttgaggcaaattccagagaaaagaagatgagtcccagaaacttccaattctccatattggccagaaaaacctagtgtcaaagggcaatcagcctaaagtcagggatgaggctgaagctgcagaatctgaaagatgggtgcagagatccagtgaaagggatcacatgggatccaaactggccagcaacactacccattacaaaacgaaatccaattatgtggtaaggaatataaatgttgtataaactaaaaggaaccaaagacccgattaaacagtgtcttctgggcccacgagaatatgcagttttccagtccgctgccacttaggaggttcctggattcccaatgaaattgaaataattctatttgaattttaatgcagaaaggagcttcagaaggctggaaaacctgaagactcccaagtagcagacattaagattgtttaatattggaaaatgttagaatatcttttcaataacttaaaatggaagagcacatttataaatatttttgtgcctttctatcaggggagtaccttttgtgccatattttatcatttattaatgataaacaaggacattgtaatgtacaagggagagtggtagacaaaaagttaaaatatatttatagaatggaaactcacctaaataagatttgcttctgaaaccttggtgagaaccttgagttcagatcaattcaaatatctatggaactagatgagagcacaacttcaaatgcatgatcattctttggaactggaatctacttcttaacacaaattacaaggccattatgtagaaaaaacttcttttaaatgcaagaatccatcctataactgaatcgtttttccataatttaagcaataagtcaacaaagtttccttcctgtagaatgttatgtcttctaatgtgtttgaaatataattaggttggatattatgttaaatctaaggtctctcacttacaattaggatcgtctaaaactattggtaggagtttgtttcctgtaattgggttgagactctttattcaatttgttgtaaagataaaagtcattataaccttttagaaaatttcaagcaatatgttttccttcagtgttggtgtgtagtaatcaccattttattttggactataaaaacttggcatcagatactctgatttgtctgctatctgttagtatatgtgtctgtgtatgtattacaatacacttggatatcttagtaaaaaatacttttttagaaaaaaccgtcagagttgaaccaatgttctttgttcttttgaatggcaatgttgtagcaaagagtaggattttctatataattttatgtattttattttttaaagtagggtagattcagcagagacatcagataaaaattgagtaaataattatttaccacttagtgatacaaattccccactgaatgttagctacaacttcaaatggcaaatataaaatagccatttactttgtcataggtggtgggtaccttaacacaacacagagcaaccaattttctctttatttccttttagagatgtggtctcactgtgttgcccaagttggtcttgaattcctgggtgccagcaatcctcctgccttagcatcccaagtagctggggcaacagtcacatgacactgtgcctggccaaagccagtatggacattggacagaaagcataactttcagttaaattaggcaggagtttagttattaaacccaacagatgcattcctcacattagtgagcctcttgcttgcttctttgattccctttatatccaccttctctgtaaaatattgtcttcccatgacttcattgattctgtattccctattctctttccacctctcagaccatatatcatttaactattgctaggtaacaaaccacctcaaaacttagtggctgcaatcatgagaatgcagaagtgcttgctaaggtttcacctgagctctcttgtggaagtttgactatggctgaaaggtccaagtgtcctccctcacatatctggcattggtgctgtcagctggggtacattggtaccccattggtacatggactctcatcctccaataagctagatcagcttctttttatatggtggcttttggcataacttcaagaggaccaagcaaaagctgaaagtcctcttgaactcacacaatatcacttcgtccacattctgctagtcaaagcaagtcacaagtgacaatccagatttaatgagtaggaaaatagactttgccttttgatggaatatattgcaaagaattatggcaaataatttactatggtctactctctggttacaattattttcaatcctctcacatgcaaaatatacaccctccccatccaagaccacaaaaattctcatgcaattatattatcaggcttaaagtttactatctcatgatttgcatctgtttcaaatatgaatgtagctactcttgaatcagaggtctgtgaatgaaaagaacaaggtatcttccactaattcccttcaaatatacaacatacaatattgtgaaagagagtggaaaagcactctcccattcaaaaatgagaaaaacaggaagcattcagccatttctgccctataacagttttttaaatcactttaagtcccaagatacaagtgcagaacctgtaggtttgttacataagtatacatgtgccatggtggtttgctgcacttgtcaacctgtcacctaggttttaagtcctgcatggattagctgtttgtgctgatgctctccctgctccccacacccgacaggccctggtgtgtattgtttcctatgtccctgtgttctcattgttcacctcccacttatgagtgagaacttgtggtatttggttttatcttcctgtgtttatttgccaaggatgatagcttccagcttcatccatgtccctgcaaacaacatgatctcactcctttttatggctgcagtatcccatggtgtatgtgtcccacattttctttatccaatctatctttgatggacatttgggttggttccatgtctttgctattgtaaatagtgctgcaataaatatatgtatccagctgctcaccataaaacaggaacagagtaagttccttgattaggctctacttttgttctctgggaatcgtttcctagtccactgttttcttgattctttcattctgagctcttgaattttcccctaaaatatctttccttttccataagaaatggcttatatttgtagccgaggaactttctcagttggcctctggaccacagaaattaggccagaggacatttttttcactctgaactgtctgaatttctccaagtctaaattggcaaagttttatcaatgcaacacccttaaaacgttttgagttttctatatatctcattggatatcactttatgccccaaaagccatatccatcactgtttttcacacaaccttctttttattttgggctacatgtgagtctgctgtgggagatgcttctaagattcttaaaagccctgtctagctgagagggtcttctgtgaatcacgtaagtctttctctggtgttatcaaagaattattagctatatcccagattaatttttaccttaggtcacttcttactttttcccagagaagtaaggatgagaaatagttttattttttcattttataacagctcttgtggcatcttctaaattccaattgcacattgaattatttcttctctatttctcttccaatagcatatcattctcagaagaaaaagaaaacattaaatggacatttttaacatttttcctgggaatttcttgaaatacttacattttctatcttgcaagtttccacaagaaacagttttgccaattttttcatcactgcatgatgtaatatgtacattatggaactaatttttcactaacaatcttcttacctacttttgccgatctagattcaatgggtaggaaaatagactctgcctcttgatgggagaattatggcaaatgatttaatttattatttaatatctgtctctatccttcactaacagtcttcttgcctgcttttcagcctttaccaatcccaagtctcaaagccaattctacttgttttagatttcttaaagcagcatctcattgctacatattaaattctataccagctacgtatactacataacaaattaccccaaacttaattttttgtgtttgtttcattttttcacaattctttgggttgggtgggtagtttctgtgttggctttgcctggtctcactgatgcagctgtatttagctgaagagctggcatgggtggaatggcctaagttggccccactgatgtcaatgaaggtgcctcattttatctccaggtgtcctctcatgttccagtagactagactggcatcttttctaggtggtctcaagataatgttctaggagagaaaaacagctgaatggtcacttattgcctaggttctgaactcttgtaagaccacttctgccacattctatgggtcaaagcaagtctcaaatctaacaaggctcaaggaatagtggaatagactataccttttgatgagaggtacttgccagaatttgtggacatactgaatctggcacatgctacttcctctgtttcctatatgctatattctttctctgatcctttcttaaaagttaatatttcatttcaacgctctgctatagagctatacccggaagtgccagccaaaccctactgacattttaacctcactgtgtaccaaagtcaaactcatcatcttttctccaaagtcagtttctcttccaatttttccaacctagttcacaacactacaatttattcaatcctcaatcctgctgatggagtgacatctgtgaagagacacaaaggagatgagaaagtaagccctatgcgaatttgagaagagaacatttagggcagaaggaacattaaatgcaagacccagaggtagaaaatgcttggactatttgaggaacaacaacatggccagtgtggttggagtagaatgagttagggagaggttattaggtgatgaatttaaagaggctgcagaggcttgagatcattcaggggctttggcttttattctgactaagatgggaatctattgaagggtttgaaacaaatgaccagaaccgacatgtttttaaagaatcactgatgttgctttgttgagaacgaactttaggggagcagagaagcagcagtgaggagactatagcttcagctataattccaatgagagatgacagtgtggcttagataagggttgcaacagtggaggggacagtgctaatttaaaagaattacactagttgaggaaaactagagcagcaagtggagatgttggaatccttgaatcaggttttccttatactggtattattttctttatactagtgttatggtattatccaccataaatcctctcttgatcacatcattcagctgcttgaaatcttgtttgtttgtttttgtgacagagtcttggtctgtcacccaggctggagtgcagtggcacgatctcagctcactgcaacctccacctccgagtttcaagcaattctcctgcctcagcctcccaagtagttgggattacagacacccgcgaccatgcatggctaatttttgtatttttagtagagaccaggcttcactgtattgaccaggctggtctcaaactcctgacctcaagtgatctgcccacctcggcctcccaaagagttgggatttacaggcatgagccaccatgcctgggcagaagttttttactggcttccttttgccttctgcgtgaagtccatttgggaattgcagaatgtcctccaccatctgtcttgtccgttttaccagttggcttttctacccctcccttcattacaccattgtacattttatggaatttggaatataatcatttacagtttactattccccactattccttctatatggttgcttactatggggtaggtatcatgtcgtaattatttttgtgtgactgtttcctagcactgtgttccacttaacagattgtcaataaatctctgaaccataactaattcctttcttttatccctaaacatcacatattttcaagaaatgactcttaatttctcctcaagtaaacttttattattgccctcactgcaaattcaaactttgcctaccagatgtcgaataaagcatgacaccaaattgcacaccctattaacatctcagtatgccttcaaattccattacactcaagtcccagtacagtggagcaaaatagctcctgtattttcataggaagaaaaaaataaatgtacagaaaaacttgaaatttgaaggattcctctcacagcattttatcattaaaccatgttttattgagctttaactttctggagaccggtcattgcagcactgactctaggttcacatgctaactttgccactttatttggcaagttccttaaatccacagtgactacgtttccttttctgtgaaatgagacctgtttataatgctgttttgtagtgcaaatgagttaatatatgctaaatgctaggaattgttcctagtgtgttctatttaagtgtttgttgttacttttattcctctaaggtgggttcaatagagagaaagttagctgagcatagagactgccttgtttttaatttggttacagataagaattttattgcttactgtattagtgtatcctcacattgttataaagatactatctgagactggctaatttataaaggaaagaggtttaattggctcacatagttctacatggctgaagaggcctcactcagaaaacttacaatcatggtggaaggcaaagggcaagcaaggcatgccttatatggcagcgagagagagagagagcaaagggggaactgccaaacacttttaaaaccatcagctcttgtcaaaactccctcactatcacaagagcagcatgggggaaaccatccccatgatgtaaatacctcccacctggtccctgcctggtggggtttacaattcagattacaattcaagatgagatttgggtcgggacacacgcaaaccatatcacttaccaataacttgattacatgatttgcagcctagctcatttattttcataacacactcatcagataagtgacctcattttcaaagcacatatacatggccttaaataaatgtctattgtattcactaacagaaaataaatatataataaaattctataataaaaaaattatttcacctgttttacagagaaacatatctctgagttgacattgagctaatatcttttgaatagaacaagattatgtgagtttgaccaaacttataaaaagtattgtagcaatgttactaattttagagtagattagaaatgcacgttttttatttgtataacataagaactatactgaatgtgtcactagaatcgtacttttctgtttttagaagacaacaagctactgactgtgggcagaaattggacttgacttatgtatgatcagggaatattgctgtagaaaggcaattaaatataattaagaaagctgtagtaatctttaaactttaagaccgctggtacttagccttgtgttaagtcgaagctgaggaaaatatatcttcaaaaaaaaagtcaccaggaacccacattaggaagtaaaaaaagagatgctgtttacctttgattctcaatatgagatttcttatctcaggagcacctatggttgaaacagggaacatgctatagcttgctacaagattaatacagtgcattttcttgactttcttgacttccagttttgctagtaggctaaaaaggggtaaggaatttaagtaaattagctcattaaaatgttagaattgttgatcttatattgaaattgctgaattgatataaaattatagaagattaatatacattgtgctgcttgcctcctcaacattgtttcattctcttctatcataaaccgccctgatttttctttgaggaaaagaaatcccctaaattattgaggcttgctgggatggatcttacctcccagtcgaggcaagcagtatatcccatctacttggctgtaataatcgctttaaggatgaacatgtgacccagtacaagctaacagagagaatatatccaagagcttgtacagaaataattaaaagagacattggagctctttgcagtcactatataaatttgataatatgaaaggcagagagcagagaagatattcattggtattacttgagcctttagagctatcctcacatgaagccacgtgttgttttctacattttattttattttagagaatgggtctcactctgtcacccaggctggagtgcaatggcatgaccatagctcactgcagccctcaaactcctgggctcaaatgatcctcctgcctcagccttccaagtagctgggacaacaggtgtgcaccactaggcccagctagttgttttaatttaagtttttatttttttgtagggacaaagtcttactctatggcccgagatggtctctaactcctgggatcaaccaatcctcccacttggcctcctacagtgctggaattagaggcatgagccaccatgccgagcctgaagctatgtttaattcttacctaaagccattatttaaaccagtaaagtctcttcattgtttttatcccaaaagaggtctaagtgatatagaaagagaggagagggaaagttcctgctttgaataagtggctactaggcttagactcacagatgtatccaaaatttacccctaaccaactatttattctacatttttctttagaatatgtcaatgaaaacatttgcaaaacccctagattatactaaaggaaggatctaacgtggcttttcaaaacaagttaattgtctatggaagatttcttgatagagtgcaaagtaaaatctagttggaagaggattcttctagaactggtttcatctttgtagagcatgtgatgttagataagaaaacatcaactgtccttacaaaagcagagttagcccaacagagagacagtggagtgggagtggctaaagtgcctcaacatatatatatatatattttggccaattttgtttcaagattcctttttttttatttttcctgattctcatctccctttggacagaacactgaattgctagaaatcatagctgctgagatcatgatagaaatgacatgttgtcacaaaatatttggcttatattttcattaagattccaaaatgttaactttgattcagaactatatacaataattttaaataagaaatctatatggagagccttctggatatttagtcttgacttctctaggatacacaacccaggaaatggctatggtatgcattccattagagagctagaacactggagaaaaattctgaccttagaaacaacatttaaacattatcaacaaactggtttaatcattggttagacttctcagtctgctgcctaggctcattcattctttcatttcacatttattgtgcttgctgtataaggtgagtgcaatagagagaaagttagctgagcacagaaatttcattttttttaatttggttacagataagaattttattgcttactatattagtccatcctcacactgctgtaaagatactatctgagactggctcatagttccacatacctgaagaggcctcactcagaaaatttacaatcatggtggaaggcaaaggggaagcaaggcatgtcttacatggcagcaggagaaagagaggggaaagggggaactgccaaacacttttaaaaccatcagctctcatcagaactgctgtatactaggcattacatgctatgttactggcattatatgcacatttattgtgcttggtatgtcacaggcacatggttatgcctgctatgttgcaggcattacacctgcattaataatagcagcccctgcccattaagtatgcactatttagttggagatgggaaaatatgtaatcaaatgattctaatatagtgcaacaaggactagagacatgctcaatgtgccaaggggcacagtggatagagtatactctctgcctcataggatcactgaagtttttaaaaaggagatgactcatgttaactcaaggagtaaataaaaattaagaaggtcagtatattttaggttaaaagcatgattatgcaaagcacagaagtatagaagaacttgggatatttgggaagctgcaaatagttgggcatgttactgaacagttcgtgtttgaaaagctggaggagatgaatctttgtggataaaaccagatcatgagagaattggtaagccaggttcaagagactgtttcacacaattcaaattgaaaatattctggtagggaaatggtataatcagatcctttaacgtagaactccaaccacagctgtaaggaagggaagttgagacacactcttgctctctttctttagactaaaccatgaactctggctataaaacaaatttggtctaggaatattccagataactttcttgcagtgaaatctgttttcacccagtgctgctgatgttctcttgctttccagtcacacgttacatttagaatgtggacatgtatatccatatgttttagagtctttgttttatgtgaaagaccttttatgggtttatatactaatgaaaataactgttccaaatgagtataatctagcaaataaataagaatagaagtcatattgtacactttttctttatgttgtagcatctctgaaatgtagaatcatgtaggtaagaatatcttttataattattgggaaaatttatacccaagcattatacatatacacttctgacaactacagaaaggtaaaaacaattgatatatcataatagtatttggaaaagctgtaacttttaaatatattttatgtgccagaaatagttgtatagttgtattactatagttgaatagtatagttgtattacttccattacttgtaagtagtaagttgtttaagcttcatgttttggaaattgatctatggctttattgacagtgatgaattactaattgttcttaccttcttaatttaaaaaactgatcttcatttattttcaatttgacatgaagaacattatggtatttatatattctatggtatttttaatatgttcatttataatatttcttggcagggtgaatttaaataacttcagtgctctttggatgaactgtactcaggcatgatctattgattgcagttaggggaaaatgacaaacagaagttgcatctgagtcataaagcaaggcttcacctttgttctcagtgtaatatcttcttattctaatttgataaaagcatttaaaaatggatttgctgatggcttaaaatgtagctttggtcaatagaaaggttaatattaaatgtgaaaaacatgataatgtgtatgaagaacgtgcctttcatccacagaaagtgaaagtgtttatctcctgctaaaattaagaaaggcaaggcaggttccctgctgtttcttttgaaaatgatcccataattatatagccaaattcaggaaaaagaacaaaaagcctttctttttttgaactcttcctttacaaaatagtgtttcatgttgatttggagtatacattaaccatatatcctgaattaagtgtgtgttgatttctttccacttttacccttcctcagagaagagaatggcagaaattcttttgatgcagaatggttcccattattctggtttgactgtccatgtgtataagaggaggaaaatcaagttctgggactattcaaagcaccctggaaagctcagaccctgtggagctctgtttccggctggctagccacatataaagactgtaaacattttcacagctaaatgacctctctacctaccttaaatgttcatcggtcttttaaagtcgaaccatccaaaaaatattattcatccgaagggaattagtttcaacttaaaggttcgttgaaatacacccaagtgttattctgaatgaatgggggtttatgctttttctaaaaactgtacatgtcttaaacctgctccagctgaagcagtcaaaaagataccaagctctgttgtactagcaatagacaacatgacagagcccagaagccccattgccattctgggaagttgtgcgccaagattgtcatacatctagaatgtatgccaatactaagggcaccctggacctgtccaatacactggcattcaagccttcatttagggctggattctgagtaccaccacagagccagggtacaattcatgtaagaagaaatacaggtggttactaaacatataagaacattgcaataaagaaatacaaattgatgggacaatatatctttttccacatctgcatactaaaataaataaaaagaacctaaaagcacccagtgttttgaaatagaaacttttacatagaaaagtagaaactatgaaatgttgtttaatcacatatgttataaacctcaaatataataatctataccatgtctagtaatttattctaaggaaccatatcccaaatgtggattcttatttaaaaaaattgtgtacaatatgtactaaaggcagaagaatgaaataacttaaaaataagacctgaaagaatgacaagcggagaacaataaaaatgtctttgtatagttaaaatctattattctagtaattactacgtacaacagaccagtatattctggtttttttaatcttcctgtcaattattcctgtgaattcttctgttctttcaccaggtccagacaacttttctattgtttgatcatttactttactatttagtaaagccattcttccttctctattattaactttcaaaaattcattgattaatagtttttcctagctgcagactcctgttttttgtaattttttgtcagggattatggaaattttaaatacatttaggaaaattaacaactttaatcacacataatctctccatccagagttcggtgtacccccacctccattatttgtcaagtttttcttaatttttcttagtggtgatgtgaaaattttgtcagatggaacaaagaaattctcaaagaaatggggttgtatgatttttgccattacttgtatttctagtgcctgtgtctctcatttagtaatcatttctcaaaaagcaaaagtcttcatattactataaagactttttatttttagagatcaagaatcaggaagccagatttttatttatgactctgctgttgaatcgtttttatataatgctttgaacgttttgaattctttattcaccaaagtacaaaagcaatatagaactgaaaattatgtgttatgtttcattaggtcttcagaaagtatttttatattgaaatatgtgtgactaatacaacgccattttctgtaactttgtagtgtggacatacttgagatagttcatctgagtttgtttaccataataatcattttggttcctttggattcaaattctacagacacttataaaatgtctaaagagacctggtacagattattttgaaagggactacaaaagtataacgaaagaaaaatatcatatgtacctgttgatttttattaaatgtgtgctatgaattgatatttttattttccatgtactttcgtattatagtggaaacaaaagaaacattgccacaataaatattttcccataacaaaagtgaaagcaatgggctgataggaattttaaaagagctattatatcactatttccacggccttgatataatctacttcttattttcaataattagcattaaactgattcttattttaccttttataattagtgatacaaaattctctaataagaataaaattactctttagctgtcaaccacagattttatgtcagattgtctaatacggtagcaaccgaaaataaaaagcagtcaaatgaaaagataaaacccatagaaaaataagcaaagtacttaaaaacagtatgtttgtgttgaatctcatttataaacatgaaagtatgtgaaagataacttgtggaaatcaatgcaatgaaatatttacccaaagaacattttaagttatattgatttccactatttcctaattaggtgaaagttacctacttcaattgcatgtttgcccatggccttggggaaacatgtacttgttacagggaaatgggggaagcaggctctgactcttaggcttctaagtaggaattctgtccaaggaataagaagagaaaggaatatgttattacgaatgccctcactccggcaaacagctctgctctttaccactcactttcagtttccctcacacagtcatgaatgatgctatcaaaatttttatcaggtcctaattctacttttcctaattttggtcacagcttgcctggatttaggacataaagagcttagaaactcttaattttaatattagaaatgtagctcaatcctatatcaggaacagtttataaaacccttttagataataatgatcagttataatttattttcatagaaaaacatattctaagatgctctatacaattgtttttacactgaattgttttactgaatggtgcctgtattgaaggcactatcagaaagggtacattgaagttgaggtaacttcaaaaggtagtgaatacctgctatttggcagtcctcttttctgcctgcccctagtccgccatttgaaggaaacgtcatacaatgaatgcatcctcgtggtggggtcgggggaggggggagggatagcattgggagatatacctaatgctagatgacacgttagtgggtgcagcgcaccagcatggcacatgtatacatatgtaactgacacgttagtgggtgcagcgcaccagcatggcacatgtatacatatgtaactaacctgcacaatgtgcacatgtaccctaaaacttagagtataataaaaaaataaataaataaataaataaaataaaaaaataaaaaagaatgtggccctgtctcagtgccctaagcttgtgacttcagtgtctctagagagttctatattagaaatcacagtggccaattagcaatttttctttaaaattagtggtcacaaagttctttgtaaatatacagctaaatgaatgtagttgggcatgtttaactcttaaaagttctaagagaatgaaaggtaacctagatgacattttgtaatcagaaggaagtacttctaatggagcaactaggttaaggactgttctgtatttgtcttagtatgtatgtattcatatatatatgtctgtgtgaatatgttcagaaatatgaaatgtctgtgtagtacatttatgatcactatgttccttaaatcaggctgattggtgatgtttttaaaattcttcaataaaagcacatacattttaaatgattacattttgaagagcaatatttgtgcattttttgaatagcacagtcagcgttctgatttcctataagacctttcagtatatttgtagactggtggtctgcatattgatccctcttgttgccatggctaaaattgatttcaccacctctgagacctttgcctgtcatcaaacttactttttctcttatgccaaaatgacatttgattggattatccaacagaagaaggcttctgtggttgagcacaatcaatatgcttgtcttcactgattttatagaccttacagtgactaccttcataaatgaaagctggagtgatttaaattctagtcaaattataccaagacttgaagatgttttacaattgtaaactcttttgtcaacttaatattcagcaagcctgtttctaaaaatattatgtactcataagtaaatatgacatcaatcaacattttcaagcacttgatatttgcatgatactgtggcatatgcaaagatatatacatgattcttagtctaaagggttttatatcctggtggcatgtgtacagtatatgcataagagataattgtcaagaaaaaggtatataattaattttaaataagtcatactatcaaaacttatagaagtaatagcttctatttatttaagccaatattatgtgtcaggcttgttatgctatgttcagctatgatgtcgatcatacctaatttttgtaacagccctccaaaggatttataattaactccattttgcagacaaagaactagcatcatgagattaagaaacttagattgtgcagcttgcaaacagtttaaaactcacctctatttgactcaaatgcctgcagtttctccaagcaccatattacatctcagtagttgttacagattttcaaaagttagagattgtttccagctgtgatgatcaggaagctttgacagagagggtgcagattaattcggtttctcaggatacaaagggttctaataagttgagagaaggaagacaaggttctaatttggaaaggaaagacacaagttggtgtgtaaagacaaagagaagaggagcacatgcattctgaaaaattgaatatactggtatgtctagagcagaagggccatctgaaagtagtttgaaaataaatttgaagagccaatagcttaagagtatagaaggatttgcatgctttctgatggtttagaatctgctcttgaatagactagatttacttgaaagctttttggggaaaagtacaatattatcaacaactatatcaagaacactattaaaatcggtattagtctgtcagaagtgcaggataatcgaatgtttgaacgatatttttccaaagagacatcctaagtcaataaatacattaagcattctcatccttattttaactgagaaatgccagttaaaaccaaaatgatacacctctacacaccaaaatggctaaaagtgtaaaaagctaaacaattccaagagttagcgaggatgtggagcaagagaactttccagacctgctggagtgaaagtgacagtgtgccagtacctagcgaagtgaacatagttctgaccaatggcttaggaatcctgccgctgaacatatacgaagagaaatgtgtgtgtaagtgcattaaatacatgtaaaggaagctaaaaatttattcacatgaatttcaaaactagacaaagctaaacaactgagttaaaagtcaaaatagtggttgcctgtaggaagaagagaaggggaaatagaagggttgtgatggcgcggggcagttcagggctgctggcagtgctctcttttgtgatctgcaaagcgattacccaggtgtttgctttgtgataataactgaatggtacatttttttagaacattactgtctataacttttacttcaataaagatattatatataaaccaaaaaattaaaaacaggaaaaaagtcatttatctagaaaatggaaataagtgattcaaattcagatatgccgaactccaaagcccataagttatttatcctcattcaggagaacagatgcaaataatgaattcttggttcatattcaaatttggtaaacaaatatgtcaggtagtctatattaataaatagtgaaaatgaaagtatcaataaaggtccatgaatgaaatatgtttctatatgatcctctgttcttaactctgatttcatttatagtccatgccataacatttgataatttattatttcacatgtgttcattttgtccagtggacttgattgtacatttctggaaaccactagccatatttaattggtttttaattttccagagcaccaagttaaagcacatagcacatgcatagcaaatactttttgggtgatacaatttcagggaaaagaaatctatgtgtgcgtgcctgtgtgtgcgtgtgtgtgtgtgtgtgtgtgtttctattttatttccagctacagggatgatctgttgtactttttcaggaaaagaattcttgtcttacctcgtttactacatgtatccactgcacctagaacaatgccagcatgtaatgaatgaagcctggcacttaccaaagcattcattcatatatgccccagttttgcttttctacaaacttagagtacactctcctacccttctctctactgaaattctacccattcctttaaagccaaattgaacagtcttctccacagtctctcacgcttcctagtcccaatcaaaagctttccccttgcatatcagaagcaatttctttgtattcctattgtagcatctctggtgctttcctcttgttatacttaattgtgtacatgcctgtgtctccaatttaaactgtaagatagtacataatgtggggaaagcaaggggttaacaaacaagcactaacattttttaaatacctactatgccctagactctaagcagggggttgtctcagctctcagaagttaaataaggtgggcagggtcaaccatccagcaagcagtcaagctctctttgtatccaggtccttctgtctctgcaggcagttcccttttcatctctccatgctatctcctgagcagacaatgtgtctgtcttacctatctgtggcactcacaactccttgcccagtgttctccacatgggtggtccggaaagatttgtaaatttgaatactctgttggttcttcagttataaatgttaaatttttctcaaaggcacctgattctagatgggaagaatgcaaattagcatatagagataatatgtctgtcagttttcataagggatcagaaaaataaacctactataaaattatcttctatgtatctcattgcatgcagctttaaaatatgctttctataaagacttctattaagttgtgttaaaaatggtgtagttgtctaccaactgctcagatcaagagaagaaactaaaaaagacttgaggtaaaatggcaatcaaaagctgatgtcaaaatattatgatatgctgggcttttcttcttttatctgattctcttgtgcttattttttacttcatagccttactttgttatacttagtgtatctatttttaatgatattccctgtttcaggagggcaaaccttttttttttaactctttaaaaatgtagttttgtgattttttaaaaataatgatatgggggccgggcatggtggctcacgcctgtaatcccagcactttgggaggccgaggtgggcggatcacgaggtcaggagttcaagaccagcctggccaacatagtgaaaccccgtctctactaaaaatacaaaaatttagctgggcatggtggtgggcacctgtaatcccaactactctggaggctgaggcaggagaatggcatgaacccgggaggtggaggatgcagtgagccaagattgtgccactgaactctagcccaggcaaaggtgagagacttgatctctaaaataaaataaaataatgatatggaagtatttatatgttctcttgcttaaacaattggacctatgaatgtgacagatggcaatgcgtattacatatacaattattttgataggaaaaatactattattttctcttttatttcattgcatcatgtaaaggctctgtctacatgaccatgactgcaattctggtaggcgatggcaatatagtgatgtatatgtccttttcttaccaaaaatactaatggcattacatgacaattggtgccatatccctgaattcaagctcattatttaatacacctggtgcctcctatgaaattattaaatatatccttattttcaaataacattttatatttaatcctttaaaatgcaatttaaattcagcttttctgtaaaggatagttttatggagatttatattgttagcaaatagcaaattttttcttaaagagaaagctttacagataagaatttaaagccaaaatgttattgacagaatttcacactgaagatggatgttggcattgactgctgtacaaacaaggtcatctctgcacacaggcaaggtcaatgggcttttggaagcttccttttataggaagatggggatgaggcactataatatagccatgaagtacacttcagtaatttttcttctggcagagctagctgatcagtagtaggtcatctagaatcgtgaatgagttctcaccaaatcattcctcgggtacacggacattagcttaatcaataaccatacttatcttgtattctgccttgtttcaaaaatgggtcaatgcattagtttaaaatttctgattttgtaagtgcattttaagtatttatgtatgtattttatgagggcaatttagcttttgggtttgaacctatttgcagtaagttcagtaaattaactacataagtattatactttattacaggttttatttattacagccagaatacaacttaaaataaagatgcacacaaataatagctcctagaaatctcaaatttagaaaggaaaacggaaaaatcacttttaaaaatgatcacaaccaaaagttctcatatttatatagtttaaacatgtttcattcactatttattcattcacagtatactttaaatcatgattgatagtgctacttgaaatattttgacaggcttttaactgagtttgggcagtcacagttatgaagtcacaactcacttagccaaagcagtactccttgtttcttctcagtaacttgtgagcttatatccctggatagtaagatacaaccaagatattatgtatgtaaatcattgccatagatgtactaaaaagactactaaaatatgaaatgtgaagtctaggtcttgttctgccacttactataaaacatgggctgtcttttctccccatcacaagcttggtttatttatctctaaaaatatatatataaaagatctctgtagctttaattttctatgacaatagctgtgtgtttggtaataaatctagctagatgcaatgagttattttcataatcagtagatgatgagttaaatttttatattatataaatagatcataattaattgttgatattgtgcttatttatggcactatggattattaaattatctgccttgtgcatttacagagtcttctttcagccaaaaggtaggtttgctgtctgaagtcaagttgaacattgtcaaaagccagagttaaataacaagtagaaaagtgggataaattcaccatcatcatctcttacagttgttccatagcaaacttgttgaagctgtgaatattcagttaaagtatcacagacctagcaagtaacattaatattctgagaggctaataaaggttgatacagagtctaatgaataaattttattgtttgaacaggaactaaaatcatagtgaaatgtttccatttttagatgaaagcatgtattttaattgtttttgataggatgggctcagatgtgatttcccattagttacatgtaaaatttatttctaaagttaatatttgcataaaatcatttatcacttatgccactcaaagcaaaagaagacggattcaaatgagtataaatttgaaacaacaagtgatcttctgaacagaaagatccatcttcttaggttagaaatggagtaacagaaggcactgtcactgaaggtggagcacccctacaaatattagtggttcttagttttggagctttcgtgcagtcatagtaaaatgtttctatgttcttccaaagaatagagtaataatcttgaaaggagaaagcaagtacagtcatttatttttaattaagcaactaataaagtaagcacacgtagtattgtttaatattactgaataattatactgctaacctgttgaaaaattttgtgaaatatttgatgcatgttaaagattgcatgcaatattatatatcataaatcttaaagacaaaaaacacttatttaaaatgttatccaattaaataaatagaaaatatatagaaatttactcataaaattgaaactcctagacccctcatgatctcctccttctcttttctcctcaagccctctccagagtgaatctctaaatgaattttgtgtttatcatgatggctttgacacatatatacgtgtgtctaaacatatcatgtttacttgttttggaactttatatacaaaatactcatttattcaacaaatattaactgactggctactctgtgccaggcactgttttagatgtagagggtataacaggatttaaataatgtatctgtcttcatggaccttacattgtagaagagaaataggcaataaatgagtaaacaagtaaaatataatgtgtcaaaacaatgataagtgttatgaagaaaaataacacaggctgaaagagatgggagtgtattattttattttgagtggtcaaggagagcctctcggaggtggaatatttaagcagggacagaagaaaaggagtgaataactcttaaaggcaactgtggggattgaatgccaaatggaggcaagaaccagtgcaaagacattgaggtggtgcacacgtagcatgtttgagaaatggcaggaggcaggatgtctggggccaagagggtatgtgtacatttgtgtgtgtgtgtgtgcacctatgcgtgtgtgcttgtgtgtagggaaagtgtaaggggggagggggatgaaggggagtaaaaatgtatcaggttgtcatatcctaatagccttataaactataatcaacacatcaaattgttttttaaattaaggtgaaatttatgtaacataaaagtaaccattttaaagtgcacaatacagtggcatttagtatatccataatgttgtgcaaccactacattgatctagttccaaaatattttcatcacctcaagagaaaacattctatttcactgtctatttccctgtcctctcatcccatggcaaccactgctctgtttcctattttttatggatttaccagttctgggtatttctataaatagaatgatataatatgtgacctgttgtgtctggcttctttaagttaccataacgttttcaaggtccatccatatgatggcatgtacaagtcagtacttcattcctttttatggttgaatcatattttgtgttcctcactttgtttattcattcatttgttgatggacatttgggatgtttccatttgactaatttgttttttggttttttttattcttgaaaagtttgctattttttattttttattattttattctatttttccataagtgattgggatacaggtggtgtttggttacatgagtaagttttttagtggagatttgtgagatcctgctgcaaccatcacccgagcagtatatgctgcaccacatttgttgtcttttatccctggcacccctcccactcttccccccaagtccccaaagtccattgtatcattcttatggctttgcatcctcatagctcagctcccacctattagtgagaatacacaacatttggttttccatgcctgagttacttcactcagaataatagtctccaatctcatccaggtcatggcaaatgctgttaattcattctttttatggctgagtagtattttacatatatatatatatatatcatagtttcttttttattatactttaagttctagggtatatgtgcacaatgtgcagattcgttacgtatgtatacatgtgccatgttggtatgttgcaccccttaactcgtcatttacattaggtatatctcctaatgctatccctcccccctccccccgccccatgacaggcctgggtgtgtgatgttccccaccctgtgaccaagtgttctcattgttcagttcccacctatgagtgagaacatgtggtgtttggttttctgtccttgtgaaactttgctcagaggtttccagcttcatccatgtccctaaaaaggacgtgaactcatctttttttatggctgcatagtattctgtggtgtatatgtgccacagtttcttaatccagtctattattgatgaacatttgggttggttccaagtctgctcttgtgaatagtgccaaaataaaaatatgtgtgcatgtgtctttatagcagcatgatttataatcctttgggtatatactcagtaatggaatggctgggtcaaatggtatttctagttctagatccttgaggaatcgccacactgacttccacaatggttgaactactttacattcccaccaacagtgtaaaattgttcctatttccccacatcctctccagcacctgttgcttcctgactttttaatgatcaccattctaacttgtgtgaggtggtatctcattgtggttttgattttcatttctctgatggccagtgatgatgagcatttttttctgtgtcttttggctacataaatgtcttcttttgagaagtgtctgttcatatccctcgcctactttttgatggggttgtttgattttttcttctaaatttgttcaagttctttgtagattctggatattagccctttgtcagatgagtagatggtaaaaattttctcccattctgtaggttgcctgttcactctgataataattgcttttgctgtgcagaagctctttagtttaattagatcccatttgtcaattttggcttttgttgccattgcttttggtgttttagtcatgaagtccttgcccatgcctatgtcctgaatggtattgcctaggttttcttctagggtttttatggttttaggtctaacatttaagtttttaatccatcttgaattaatttttgtataaggtttaaggaagggatccagtttcagctttctacatatggctagccagttttcccagcaccatttattaaatagggaatcctttccccattgcttgtttttctcaggtttgtcaaagatcagatagttgtagatgtgtggtattatttctgagggctctgttctgttccattggtctatatctctgttttggtaccagtaccatgctgttttggttactgtagccttgtggtatagtttgaagtcaggtagcgtgatgcctccagctttgttcttttggcttatgattgacttagcaatgcgggctgttttttggttccatatgaactttaaagtagtttttcccaattctgtgaagaaagtcattggtagtttgatggggatggcattgaatctataaattactttgggcaatatggccattttcacaatatggattcttcctatccatgagcatggaatgttcttccatttgtttgtgtcctcttttatttcgttgagcagtggtttgtagttctccttgaagaggtccttcacatcccttgtaagttggattcctaggtattttattctctttgaagcaattgtgaatgggagtccactgatgatttggctctctgcttgtctgttattggcgtataggaatgcttgtgatttttgcacattgattttgtatcctgagactttgctgaagttgcttatcaacttaaggagattttgggctgagacgatggggttttctaaatatacaatcatgtcatctgcaaacagggacaattgacttcctcttttcctaattgaataccctttatttgttgctcctgcctgattgccctggccagaacttccaacactgtgttgaacaggagaggtgagagagggcatccctgtcttgtgccagttttcaaagggaatgcttccagtttttgcccattcatttatgacagacccatattggctgtgggtctgtcataaatagctcttattattttgagatacgttccatcaatacctagtttgttgagagtttttagcatgaagggctgttgaattttgtcgaaggccttttttgcatctattgagataatcatgtggtttttgtctttagttccttttatatgatggattacatttattgattcgtgtatgttgaaccagccttgcatcccagggatgaagccaacttgattgtggtggataagctttttgatgtgctgctggattcggtttgccagtattttattgaggattttttcatcgatgttcctcagtgatattggtctaaaattctcttttgttgctgtgtgtctgccaggctttggtatcaggatgatgctggtctcataaaatgagttagggaggattccctgtttttctgttgattggaatagtttcagaaggaatagtaccagctcctctttgtacatctggtagaattcggctgtgaatccgtctggtccaggactttttttggttggtaggctattaattattgcctcaacttcagagcctgttgttggtctattcagggattcagcttcttcctggtttagtcttgggagggtgtttgtgtccaggaatttaaaacagtttctttatccagtcgttgactgatcggcatttgggttggttccactattttgcaattgtgaattgtgctgctgtaaacatgcatgtgcaagtatctttttcaaataatgacttcttttcctctgggtagatacccagtagtgggattgtatgtatttatgggtatggtgtgatattttggtacacgtatacattatgtaatgatcaaatcagagtaattagcatagccattacctccaacacttttcatttatttgtggtgagaacagtaatgctgattatcttccaatgttcagattcttaatatgtcatttaacttatttttgattcttcagatgttatttttttttttttttgagacggactctggctctgtcgcccaggctggagtgcagtggcctgatctcggctcactgcaagctccgcctcccgggttcatgccattctcctgcctcagcctcccgagtagctgggactacaggcacccgccactgcgcccggctaattttttttgtatttttaatagagacggggtttcaccgtggtctcgatctcctgacctcgtgatccacccgcctcggcctcccaaagtgctgggattacagacatgagccaccgcgcccggccttatcttttaattttaaaatttgtaactgcactgttaacatggatcatctgtaaattgtaaatattaatttacatacatagaaaaagcagcattgaaaagttatttgggttcaatacatttctaacctttgaaatcagattgtatggtagctaaatctggaacaattttgttggatgagaatgtgtaaaggaaatgtctaatttttgactttatattatataagtcagttattgtgtcttgaaatgattgcagttcatcactgctctagtacttgccaattgctatgcatgccgtaaaccaaaacatgtccatatcaaagccccaaagaaaactgttttgttcccagtggaatatagaaagctaaaaacattaaactttaaagttaaatttaaaagttaatatttaaagatttaaaaattatatgtaaagtgtatatttttaaagttttattttgtggtaagaatacttaacatgatgagatataccctcatatttttaagcatataatacattattcttggctgttggtatagtgttatatagaagatctctagagtttattaatctggcttcactgaacaatttgttggtaagtcttcatttccctctcctacagcccctggcaactaccattctactctttgattctatgaatttaactattttatatatctcatataagtggaatcgtgcagtattcatattgctgtgactggcttatttcacttagcataatgtcttcaagattaatccatgttattgcatattgcagaatttcctgcttttttaaggctgaatgttattccactatgagtatataccacattttctttatccattcataaatagacacttaggttgttaccacatgttgacaattgtgaataatgcttcaatgaacatggtagtgctaatatctctttgacatcctgatttctgctttttgggataattacccagaaatggggttacagcatcatgtagtagttgtatttttaattttctggtgaaccgccatatcatttctcagagcagctacaccattttgtattctcatcaataatgtacaaggattctaatttcttcatattctcaccaagagttgtctttttttttcaccttttgtttttgctttgcctttgcctttgatcatagctgttctgacaggtatgaagtggtatctcattgtggttttatatgcatttacctgatgattagtgacactgaacattttttcaaatacttgttggctcgctgtatttcttctttgaagaaatgtctatctagtccttaatctactttgtaatgcagttattctttttggttctttgtctccacccaaatctcctcttgaattgtaatccaaattgtaatctccaggggtccagggagggacctggtgggaggtgattggatcatgagggtggtttaccccattcagttctcatgacagtgagtgaatcctcacaagatctgatggttttataaatggcagtttttcctgctctctctctctctcctgccaccatgtaacacatgccttgcttacactttaccttctgccatgattttaagtttcctgaggcctcccttgccatgcagaactgtgagtcaattaaacctctttcctttgtaaattagccagtctcaggtagtacctttacagcagtgtgagcacagattaatacataagagttccttatattttacatgttaagcttttatcagatgtatggttttaaaatatttttcccatccataagttgtgaataatacattaaagccttacaataaaaaccaaatatttcttccactgtatatataaacagaaaacatgaatactttcagaatatttactcattataaaaatatgccaaattagtattattagcagtattatctatttgtatgtaacaactccagcagttaaaaattaaaaaaaaaaaaacacacattatttcatggaagagtcagtgaacttgtagagcaataaaaatcatacctggattaaataatcctaaataaggataatatttttgttacttatttcatacacaagtcagtataaacacttgaagaataaagcagaatcatgaatttatggattcagcatagtattcgggcatacaaatttcccaaattgccattttagatattgttataacaatatataaagtcactaaagcactttcttttgagttatctttgtattggtgagaattgcagtgatatctacataatataaggctttatattagaaatttaacatgaactcaccccagaaaaaaatttaagttgaaaaattaaaatgtagagtgagtatccctaatacaatgcagtctttgacttgttcttcatattactttcgagctcttctaaattgctctttagaaatcctggcttgcttcaaggtccatagtacctcactgtgactgcttaatgtctttaggtatcatgctcacttatttactcagaaaacatttaataagaatgttctgtgtgtcaggaacttttaaaaatcactaggcctacagcaatgagagatgaacagacagtacccctgacctggtagaacttacattgtagggagaagagacagaaaataaacacacaaaaagatacagttcatgatcaacatatcaaaattgtgaaaagtattggggaaaaaaacaaaggggtacggtgatggagagtgacaggtgggtcatgcaaagactctctaggaagatagaagttaaatggatacttgatatcagggagcaggctgaacatcagaattcccagaataagcaaatatcagagaggaaagtgttagaactggaggggagaacagagacagtagaatgcttaaagtgttccaggaacattgaaaggccagtaaagctgaaatggaataagggagaatgagaagagtagagggagccaagaagcagatcatacagggccttttagaagttgggaaataattccatgttaatggaaagccactggaaggtttccacagagaatgttgtgatctgaactatgttttaaaaggcttattctgactgctgagtggagaacatactgtgagagagcaaacatagaaggcagaatctggaaagtgaccacatcagtcatggaaccatcaggatgtaaatgaatgtagtactaataatggccacagaaagcaagttaagttcttataattagtggtgaaatgcattctctttggtgaagaaaatatgtaattaacagaaaaactttaaaaatcaaaacatcaggcccagcgcggctcactcctgaaatcccagcattttaggaggttgaggcaggtggattacaaggtcaggagatcgaaaccatcatggctaacacagcgaaaccccatctctgctaaaaatacaaaaaattagccaggcgtggtgtcacatgcctgtggtcccagctactggggagggcccccttttgaagttaaattatctgcatgtactgaggatgctgcttcattcctgcttcagggactgtgccacctctggacaatctctttacctctttttgtctatcttgttctcataaaattgtatttaatttgcttcagaagtgctttcaaaaacaggtgctctttgcaaagcactcttagattccccatcccgcaagtccagattcttctcatgtcaagtcactacgagaagaagaaactagataatgagccccatagttatataaatctcaagccacagtgcttgtcctagtaatatggtaactgcacagatggcagtcgtttggcatgcttcatatcccagttattctgaatcctaacctcacttctcagcatgtaaaatttgccataaccctattgactgaacacccaatgttgtatgcattcttatttttcattctaatggaaaggattattcttcctgaacccatccaagccttttattatgtgaattctttagtgtattttaattgtttgccttaagttatattcaaaatgcctccttttaatttagatgtttctatctttggcagggtttctattcccaattcaagtatgagaattactttgccttctttcttttgtcttctgttcaaatcttttaaattaaaaaaaaaaaaaactttacactggtagtgttagttttcggaaacctaaggtgtagctgagggttcttttaagtactgaaatcatcagtattttaagttgaaaaggaaaaggaaattagactctcatatcaaatatttgaaatggatatttgaagttagtagcccttgtaaaacattttgagagaagaatttggacgattaatgaaattagctacaaaacttaaactattattttcttttatcaaagaattttagtcttctagtatttagaatatccagattttcctttcaaaacataatttagttttttcatcctctaaagcttcatgaattcaagactttttctaagcaatgatatttttatttaaatctgcttaacttcctaccgaaccaaatgagaatatgatggctgaagttaagtttgacaatcaggagttctgaaacatgcctgcatctctaactagttgccttatgcctacaacaaagatattacataccttagcagttattatttttattaaagtgttttggattgtttaccttaaatatatttccaaatctccttttaattttgccagtttaataatacatacaactaaaatttacaaataaatgcaataaaaaaaaaggagttagttgtcctttctttttaaaccatccagaagaaaatggttcatgcaaatgtatcaggcaaatggatggtggaattgatttactgagttgaatctcaaattttgctaaatgattatcacaatcatgaaaaatttggcccaagatgaatgtttaactctcaaacatattcaattttgttacaatatatgtagattattatcttacctgccacatcctggactacttcatatagatagctccagggaaaaccccactttgtaggccagattatatctagggtgtgtttgtgtcattttttaaaaaaggaataatagcggacagttattctttttaaaattttttttattttaggtttgggcctacatgtgatgatttgttatatagacaaacatgtcacagacttttgttgtacacattattaggttggtgcaaaagtataatattacattacccaggtattaagctcagtaccccatagttaacttttctgctcctctccttcctcccacccttcccatcaagtggacgccagtgtctcttatttccttctttgttttcataagttctcataatttagctcccacttataggtgaaagcatgtggtatttgattttctgttcctgcattagctttctgaggatgatatcctccagctccatccgtgttcccacaagagacatgatctcgttcttttttatggctgcataatattccatggtatatatgtatcacattttctttatccagtctgtcattgatgggaatttatgttgattccatggctttgctattgtgaaaagtgctgcagtgaacatttgcatgcatgtatctctgtggcagaatgctttatatccctcagtgtgtatactcagtaatgggattgctggaccaaatggtacttctgcttttagctctttgaggaaccaccatactgttttccacaatggttgaactaatttacgcttctaccaacaatgtataagcatttccttttctctgcaaccttgccagcatctgttattttttaactttttaataatagtcattctgactggtgtaagatggtacctcgctgtggctttgatttgcatttctctaatgatcagtgatattgagcttttttgcatatgcttgttggacacatgtatgtcttcttttgagaagtgtctgttcatgtcctttgcccactttttaatggagtcgtttgtttttcttgtgtaaatttgtttaagttcgttatagatgctggattttagatctttgtcagatgcatagtttgcaaatactttctcctattctgtaggttttttgtttactctgctgatagtttatttttctttgcagaagctcttaagtttaattagatcccatttgtcaatgtttgcttttgttgtgaaaattgacatcattgtcatgaaatctttgcccattcctgtgtctaagatggtattgcctaggttgtcttccagggtttttatagttttgggttttacatttaagtctttatccatgttgagttgatttttgtatatggcataagaaaggggtccagcttcaatcttctgcatatggctagccagttattgcagcaccatttattgaacaggaagtcttttccccattgcttgtttttgtcagccttgtcaaagatcagatggtcgtagatgtgcaaccttatttctgggctctctattctgttccattggtctatgtgcctgttttggaatcagtaccatgctgttttggtcactgaagccttgtagtatagtttgaagaggggaatgtgatgccctcagctttcttctttttgcttatgatctccttggctatttggactctcttttggtttcatataaattttaaaataattttttctagaagaatgaagaatgtcaagaatgttattgatggattgataggaataacattgaatctgtaaattgctttgggcagtatagccattttaatgatactgattctttctatccatcagcatggcatgtttttccatttgtttgtgtcttccctgatttcattgagcagtgttttgtaattattttagagatcttccaccattctagttggctgtattcctaggtattttgtgtgtgtgtggcaattgtgaatgggattccctttctgatttggttctcagtttggttgttgatggtgtataggaatgctggtgatttttgtacattggttttgtacctagattattgagagtttttaagatgaagggatgttgaattttatcaaaagacttttctgaatctattgagataatcgtgggtttttttctttagttctgtttatatgatgaatcacatttattgatttgcatatgttgaaccagtcttgtatcctggggatgaagcctacttgataatggtgatttagtttttgacgtgctgctggatttggtttgcaagtattttgctaaggttagttgcatcgatgttcatcaaggatattggcctgaagtttttgttgttgttgtgtctctgccatgtttgggtgtcaagatgatgctggcctcatagaatgagttagggagaagtccctcctcctaatccttttggaagagtttctgtaggaatgataccagctctttatacatctggtagaattcacctatgaatcttttaggtcctcctgggcttttttgttgttgtttttagtaggttctttattactgatttaatttcagagctcattattggtcttttcaaggaatcaatttttttcctggttcagttttgggagggtgtgtatgtccaggagtttatccatctcttctaggttttagagtttgtgtgcatagggttgtttgcagtcatttctgatggtcatacttatatttctgtgggatcagtggtaacattcccttcatcatttctaattgggtttatttggcttttctctcttctattagtctagatagtggctaaactattttattacttttttcaaaaaaacaaactgctggattcattgaccttttgaatgtttttttgtgtcttaatttcctccagttcagctctgattttttgttatttctcatcttctcctagctttagggtttatttgctattgcttctctaattctttcagttgtaaagttacattgctaatttaagttcttcctaactttttgatgtgggcattttagtgctatgaattttcctcttaacactgccttagctatttcccagagattctggcatgttgtatctttgttctcattattttcaaataacttcttgatttatgccttaatttcagtatttacccaaaagccattcaggagcatgttgtttaatttctatgtaattgtctgggtttcagcaattttcattgtgttgatttctatttttattgtgctgtggtccaagagtatgtttggtgtgattttggttcctttacatttgttgaggactgttttatgtccaattatgtggtcaattttagagtatgtgccatgtggcaatgagaagaatgtatattctgttgcttttgggtggagatttctgtatagtctatcaggtccatttggtccaatgctgagtttaggtcctgaatatctttattgatattctgcctcaatgatctgtctaatactgtcagtggagtgttgaagtctcccactattattgtgtggggagtctatgtctctttgtaggtctctaggaacttgctttatgaatctgggtgttcctgtgttgagtgcatatatatttaggatagctaagtcttctcattgaattgaaacctttaccattatataatgcccttccttgtcttttttttttatctttgttggtttgaaatctgttttgtctgaaattaggattgcaactcctttttttctttttttttttctttctttttttgagacagagtttcactctgtcacccaggctggagtgcagtggtgcgatctcagctcagtgcaactttgcctcccagattcaagcaattctctgcctcagcctcccaagtagctgggattacaggcacccaccaccacgcctggctaatttgttgtatttttagtagagatgggttttcaccatcttggccaggctgatcttgaacctacctcgtgatccacccgccttggccccctaaagtgctgggattacagatgtgagccactgcacccggccccttctttttttcttttttccatttgcttggtagatttttttccatccctttattttgagcctacaagtgtcattatatctgaaatgggcctcttgaagacagcatacctttgggtcttgcttttttatccagcttgccactctgtgccttgtaagtggggttatttagcccatttacattcaaggttagtattaatatgtatggatttgaccctatcattgtgctgttagctggttattgtgttggcttgtttgtgtggttgctttatagtaaccctggtctgtgtgtttaagtgtgtttttgtattagctggtagtggtctttcctgtctatatttagtgctcctttcaagatctcttgtgtggtaatgaagtccctcaacatttgcttatctgaaaagcatcttatttctctttcacttaggaagcttagtttggctagatttgaaagtgttagttgaagatttttttttcttttctttaagaatgttgaatataggcccccaatctcttctggcttatagagtttcagctgagaggtccattcttagcctgactgagattcctttgtaggtgaccttctcttactctttagctgcctttaacattctttcatttcaaccttggaaaatctgatgattatgtatctaggggatggatgatcttcttgtgaagaatcttgcaggagttctcttaatttcctgaatttgactgttggcctctctagcaaggttggggaaattttcattgacaatatcctgaaatatattttccaagttgtttgttttctccccctccctttcaggaatgccactgattcatagatttggcctcttcacataatcccatacttcgcagatgttttgattatccctttttaatagttgttctttatttttgtctgactgtcttatttcacagaaccagtcttcaagttctgagattcttttctcagcttgttttattctgctgttaatacttgtgattgcattgtgacattcttgtgttattcagctctgtctgacccattagattcttttttgtactggctatgctgtccttcagctcctgtattgctttactgtgattctcattttccttggattggggtttgccatcctcctgaatctcagtatctttgttcctatccgtattatgaattctatttctgtcatttcagccagttgagtctggttaagaacaacttggcactcctaggctgcccactgaagctctagggaaatcttggtgtttatatttcttcttcagcttaggggcaacagaggaagacatcttattagtggttgtggtcaagtcatttgcttgactcctgagagtcagagagatgcatgtcaactcagtgcagtcagcaggtcatgcccagtgtagtcagcccaagatggaaggtttgtgctgagggcccaagccaggagttccctgtctggtgacaagccatgaagggtgtgtggatcccacaggagttggactgaccgcctctccttgggtcaactgcagcttgttggaggtgtggataaggcccttagggtctttgctccttcattagtctgaggatggcaagggctgttccactacagaggcagtggcagagaggctttcatttgcccctggaggctctgtcaaaggagttgctgagttggtactggcttgataactccagtgcaaggtggctgaagatccaggcttggaggacctgcccagtgaggagatatgagaacgggaacccatgtaacagtctggccacttttccatagggctgctgctgtatgcttggggcctgcttcagtccctagtcacctcggattttctggaacctggaggtatcaccagtgaagactgtgaaacagcaaagatggcatcctctctctccctctaggagctttgtcccagggaagtagggacatttttgccacccaaaggcatctgcatgaagtggctggagaccctagttgggaggtcctgtccagtgaggaggaataggatgaggacctgctttaaaaagcagtctgggcatgttttgataaagcagctgtgctgtgctgggggtccagtccacttcagcccccggtcacttcagatagccaaaggctggaacagctaagtcaccaacagcaaagatggtggcccacccttccctctgggagtgcagtcccagggggaattcagatctctgtcaactggagagctcaagcaggagaggctggaggtcccagttgggaggttccacccagtgaggaggaagaggattgagctcctgtttaaagcagcagtctggccacattttggtagcacagctatactgtgctggtggatccctttcacatctccaaagcctaaaggctagaatggccaaggcacccaaacagcaaagatggcagcccgcccctctctctgagagctccttcttagggattccaagccagtgggtcttatcatatgaggtgccatgaaagtggggtctgtgggctgttatggatcagccccatggcttcagcctcttatctaggggtatgtacaggagtctaagctcccactttgatggagctgcagctacttttgccagaaggcccaagtatctaaggctccagggtcttcacacatgcctgagcggctgctctgccaagactccacatagctatattggactgaagactgaaggtggagtgggttctcaaagagatctcctaacccaagggttgcaaagatctgtgggggaagcatggtttcccgggatcgcttattcactcatcacttccctgggcaggggatggtcccctggctccatgttgctcccaggtgagccattgtcttgtcttgtttttcttccctctctgtgagtcaggttgtttccttgattaatcccaatgcaagtacctggaagtttcagtgcaaggtgttatatttacttgcccttctgttcctctccctgagagccacagctcttagcatactagctgcttctagtcggctatcttggctactagtcaacagttattcttaagataaacattttccaagtggaaagttctattatgtattaaagattattgagagtacattatactccaaaaaatgtatttaccaaaaaaatgaccagtgttttccatatctttgaaacaacattggattggtaattggctttgtttgaactactttctcaggagttaccttattcctaatgtcccctaaagaaatgcaatgaggtacatttttatcaataccattagttttatatttgacagatgcaccaaaatatctggcctatctcaacaaacatatgtctattatcttattgattgatatgttttggctgtgtcctcaaccaaatctcattttaaattgtagttcccataatccccacacattgtgaaagggacctgctgagaggtaattgaatcatgggggcagtttccctcatcctattctcattatagtgagtaagttctcatatgatctgatggttttataaggtcttccccctttactcagctctcattcttctgcttcctgccaccatgtgaagaaggatgtgtttgcttccccttccaccatgattgtaagtttccttaggcctccccagccattctgaactgtaagtgaattaaacctctttcctttataaattaccccatctcgggtatctccttatagtaatgtgacaatggactaatacattgatttacgttggatagcttaatttctggactcatgacatctatattgtctgctctaataaagtctcacaactttttagcctcagtgtctttatttacctagattcaatgattgttgactttggttctacccttggttggctaaatgttttcatttgtttattttgtttcaagaacatttcattgtatgttttgcatgtttgagtgaaatttgccacttttatatttcatctgtatagtttccttacttgtagaagtgagataatatctcctgcttctaaaaattagtgtaagcagcttacgtagccacaggctcctggcccttggaagaagtgtaatttatttgtgttccttagtgcattagatagttgagcacaatgctgtggaggaatatctatcatctctgtaacgataatttggcctcatacatgaaaaaaattacggatgtctcagccctaaaccccaggtcatatggtcactgaatctccaactccatcatcaacttgtgtaaccttgggcaagtgttttccatactatgggcctcatttcctaatccttaaactggatcacctctcgcatattttcttgccacatacaatagtgtattattgaaaaatcacaagagaagacaaataaattaagctagtctctcacactaagaggggacagcatagtataaagttggggacattaatcaacttccatggttttatttctctgtaatatgggtataataatcatgtctacttcatagagttgttggaaaattatatccgctaaatcctgtaaaacacttaatgcctggcacataacattgcacaataaaagtcagcaattattagttccatgttataattttatgttcatgactttcagattagaattcaggaacattatagtcacatataagcatagcatttctgcatacttctgattctgtagaatatatcactttaaaaattcatgataccagaagactagctgacaagattctcccatttgggtctctattagtattctttccattgacttcccagtaacttaacttgtctaaaaatcttaactctccaaatcccctgttatttcgattctgtgtatttcatctcatccattttcccccggctttgtaagtccatccaaactcaagcaaagtagcttattattcttaccctcagggtaaagacttcaaaagtctcagcacattatctatgaaactcattctgcctgcatcttctctccttgtttgatcacataggcagcctctattccatctttaatatgtgcacataagccaaaccctttttaagatttttctagttcaatagtggttttgattttgtaatggcttctagagagcagtatcttggcatacgatgctagaagatacagttttgcaatagaaaatcttcaaattgattttatgttatcttctttgaaactgttcaccaactactacagaattgggaggtaaaggtgtcagtttgtaagtgaatgtggtaatgatttccttagtatcctagctgatctttggcaaaagcattcacgtataagtgctgtttatttctcttctttctttatttgcttatccatcatatttttaacatttttctcataagcacctacggccaagggtcttctaaagtttacctacttactgcatttgttctgagccacatattataaaaatatgatataaaacagcacatacatacaggatgttacgtatttttaaataaaggttaatttataaatcagatgaaatttaatctcaatgagcaatgatttgtaagctagactttttaaacttttctagtgaatataatgtttctggcaatttagcaagctacaagtttgaaaaaagaaatgcatcaaaggtcaagttgcccataaaagcattactgaaatgtcaaaaacaattacactgcacagaagaataaacccccaaagatattaaacatccatttatgaaaagtcttcttcatactgcagtttcatctcccaaactcatacatttgattatttccaaattttaatatgctacatagaattaatatattttaagcatagattatctctgaaagaaaaagaaaactatattttagaaaatgctgtattataaaggtttaggtaaaacataagcttatttattttaccagcttttatgaagtgcccataagaatgctcgtgcctggaagttatcatatgatgtagagaacatagactttggagtctgggaatatggactagaaatcctgcctttgtcactaaatagctggtaacttcgggcaaggagaaaagaattctttttgattctgtatttcaaatgccataaaatgtgattttacttcccacttgaattgccatattatcatgcttgaacacagtagctattcataagtattattttctttcctttcatccctggatgtaataatcagtgtataactaatagatttttaaacagtaaagcaacattgtaaaagaatgttagattattttacctggaactttagtcataggctgatttagattggggagaggtttgagtctctagttcaatcctgtcatttggggatttttgtggtccttgttttgttttgaaattataataaaaacagtgggaattaagagtggaggacttataaagaaatggttgattaaacccagaggttttatttatagtatttaacaaagtatttagtgacaaaggcacaggcactgaccaatcagaagagaggccatgaccagttggttttgtttttaaaactcaatatgtctttatccatgcagaccagcccacatcaactgactatttgtgccacattggcatcagaaaattgtatataatatctgtagcctaatgtaattatgtttcaattttagagactattttcttccttctataggagcaaaattcccactaacgtttatctgtacctgcttttagattttaggtaaaattatactaaggtgtattggtataaatctgtgtgtatgtgtgtgtgtgtttcttcagagcagtaattgtattttattgaatcataattaaatggtcctcctaacactcgtcaaaataccttataaactagatgatattacccccaaaggtttctattaggcaaccactaccataaaacttcattaccttctctgttcatagatgaccatgaaacaaaaaagagtccagtctggtttacttatggctctttaaaatacttaaataattgcttcaactcagagcatgagatgaacaacaaaaaagaactctttgaaacaaattaaaatggtacaatgggccaatattgtttaccttcaattaaataactatatgtaaattcaagttacaaatatgactaggagaatttggtttgaaccatcaactctttcttcttacatattggattttaaacaggaatgagcagacatagtagttcccacatactaatgcatcagaagcattagggacctttaaaaatgaataaccctaatatcttcccctgtccatccaattgagtagttctctgatggaactgaagataggatttttagaaacttcccatcaggtttgaaacgtgtgagctagactcattcttctatctttttcaagatctttgttctcgttgttctttaatttcaacgtatgttgactggttccagagttccatcttggcccatcccaaactcaccaactttttatcaggtcagatatgaacattttatagaactctctgccttgttttctgcaaatattcattaaccatgatttgatttggtttgattaatagacactttctttgtcaatcaacaagctaatgatgctttctgtatcagctatatacgttttattacaaattcttacaaatgttaataacgctgagacagccctgagcaacttttcataaatgctaactgttgatgaaatgggctgggagttcctaatacatgtgtggttcccaaggtggaagagaaccacttctgaccaacttatagagcacttcctccattgctgaaatttcattctccctaggattcttttcctgtgatctcctagcagacaactatgaagattaaagggtcagactgtgatttactcagctgcaggccttaggctagtctttacggttcaaagtttttgtgtttttacatggggttcatagaggatagagtgggaagttttggaaaagtttaatggtgatgattaattctttggattagattctgcttcaaagccttcccacatagaccagtctcctacatttatattgctcttcctcatttccaagcacttagcttcagttctctccaaatattgttcagatttcactgccttagaaatgttttcctttatgaactgtgccatctctagtcacttcatcaatccacaatctccatcagtgggtcaaaattttacactgtgtttactggtgcttgttttcgtgtgataaatatagaatgtgtaagtcatttggtcttactcatcctggcaagattccaaagtcaaatatagttatatttaagctatttcataatttccccattacccagtagacttgtttgcacactgtgatcttgtaataactgtctgtggaatatgtggtataactatactttctttttatttttatgaatctgaaagaaatcccaagcagtaggagtacagaaagagaggcagtaatcattgttttaagcaagaaaatttacaaattgaagttggtttttagcctagtccttaagagttgataaaggcacagagtcatcctcttccagtccatggggtcttttgcaccttttctggttgcaaatagaggatagaaaatggacttgctagacaaggtgtgtcaagtgggggcagatggcggaatgtctctaaaacacaacagacgtgaatgcatgcttgatcaggagaaccacagagaatcattagagggtgtaatgtagtcacagcagtgtggctggcaagctatttggctgataatttgcaggacagattggaagtgtgaagacccctcagagaaaaaagtgtgagataaccaagacttaagaatagaaagaaagaaagaaaaagccactcaaagggctcacccaaaaagagcgttgcaaggctccacgagggactaacttgagattagaactcataagcttccttagtgtgatggagggcaaagctggagagatcaacacaggagctgtatttcatcccagagtaaacggaattctgttgaagcacttgatgtggaaccatctatttatgtaagctcttaaattaattaagccaataaattctgatgaatgtgactatttgggtgattgtattgattaactcttcaaatgactatgatatataatttatcttatttagtagcataattcctctcattaagtactgtaatatagctcagtgtaactgtatcatagcacttccagaaaacatttgtttttcttcctgctagaagatgcctgagaagatttgatgaccaaatgtagctgtgtatagctgtttaaattacagttttgaaaagttcatgttaattacgtagtccagagagaaaggggactaaaggaactttatagaatgccatgtgtcttagtactcctactgatcactgtgagctaaatattgtgtagtacaactttcagtccaaatttttaattgaagcccaaagatacttagaacccaactctaaataatttataaaatatggactataaaatttaacaatcaaaaattacgtaagttagcttttcctaggatttctggatttcctcgcaaccttagcactttaacaaaaggaaaaatgcaaaattactgaatgatgaagatcatactctgagtctagtacaatgtatatacctgtaactttccacaagtccacacataagcaaaattcggaaaaaatgattaagtacatcaaatcaagtgaattggaacacagtggggtttagaatggagcagatccatttctgtagtagtatgggagggatggtcaactcctccacagatgagtgatgaaaatagcctcatgctgctgtcatattgaacaaactttatgtgccaataaaaatttttctcagttaatatgaatgggaataccataagtactattattagcttccattaagattaagtaagttttagaatagttaaattatctgctcaagggcacattagtggtaagtgggaagccagaatttgaactagttactaaaaaactaaatgtggagcacatgaaaattaacattttaggtcatttcaagcttaaaaacaactgagaggaatgaaatcacaagaaagaactattcaagaatgaagatataaaatgaataactggggaaaaaaggaataaaacatttttcacacctttattcaaaatacatgtgcatttgattatacccatactgtacactcagagaacatgcacatgtaccatgatagttggcattaaacaggagcagaagtcatgagtctcatgtcaaagcttacagagtacacacataccctttttgtctgtctaacctcaagtgaaatccttaaccagagttattaggaagggaagtcatagatgttttaataaaatttgtttgcctaatgccctgcttactaagtgggcaacttatatcatgggtgggttaaattcaatgaaataagaaaatgcaaagttatgattggatttagccctaaattttcatcatgtatttaaaggtcatgttatttactgcactttgttaaaatgggttctatctccggaatgaagtcaaatgtgatattattgattacaacaaagcctgggctggaaagtgggtgctatcagaagaaggaagacagccttttaccccagcatcacctattcattttgctagggtcatgaaggaaaaatatgaacataaatatatgaacagaaacttgagattttaaaaagtgacagggaagagagcatagtggaaacataggcaaacttattgtgaataaaaagggttttgaaaatgaaatccctgaaaataattgtatcatactgtgaagactcccaggtttcttaaagatatttaaaaatcaataggtaaatatatatgtgggggaaaaaagagaaacctaaagataatatatcattataaattgaatatcaagggtttgttaaagttgtaccagacaaagctaaactagcaaagaaaagtgtatttgagattattaaaacaggagaagattgaactcaactcttgcagtaatatttttaaatactggagtgacctagtggaaaaagtgctagaggacgttagggggtggggtgaacagtgggatatgccaagcacattgggttattcctgagtttgcaaatgcttttctctatgattagtccatctgtgtttgccaattaatgcctatagaagttaggtacctgccctcctacagagactgggagctcagagcactatttccctcaatgttaaaatttcaaagacccagttcctatttccttgagaaagataattcctggtttgcaaaactggcaagaggctgggagaagatttacatacattacaaaggggcagagaaagaattacaattgcaagtttcctaaaataagtcctttaagaaaaaagaggtcaggggcctatagccaggaagaaatctgcctaatgcttaatcaagctgaagtgaatttcaaggccttcttggttaggttctagtaagccaacaattagaaatgtataaacaccagtgcttttttcttttgcagaaaagcaatataggttctggcattttaggttcactttttcccctcatccaacaaatatttactgtgaaactctaaaataacagtgactacaccaaggactaaaagatactgaataagacaaactctctggccagaaggttctcataggctaatggaagtaaaggtgagtgaacagggaatgagaaaaagttttaaaagtgacatgtctgcaatgctatgggagcagacagggcagagcacaactccatctggggcatttgagaaagtcaaataatgttcacagaggaagaaaaccgagtcctaaaggaagacagcgagagatggggacaccaggcatgaagaacagtgtttgcaaaatggcagaggagtgaaaaagcagcatgtcagttcatggaaaaatgaaagctttctgtggatagaatgtagagaaaacgtgaggcaatgacagaagatttctattttctttgttctagtgaggaagttggttttcagctaatatatattggagagactatagtattcagacttagattttagaaacagacccttgggatacaagggaaatgagatacaacagaatcccaggggaaagtgtgcaaagatttggaagagaaaatggattcgagatttgtaaaatcaggctcactacctggatatggtagcaaaaataatgcagggattaaaattgacttggaaactttctatttaaaatgaagcaatatgtagcttcattttgagaaggggagtgaagaatgaggcataagtctcagttcatgggtcttcttcagtaagctgagggtgattctggacctacataccttatggttgttagagagttcagataagatggttatatgaaaatgttttctagaaaggtccatgcaaatatgagactccattttttccctctttaattcttttgtaaacttttattggttatcaataaataaatatataaagactatcactctcaaaagtcaatgtgaatttttaagataatttctgaagaacacaaaacatatcaaaaactcagtaataattatcggagttactccggattttgtatagatctggcaagagaaatctaatctcaaaattacaatcctgggatctctctaaataatgtgctttttaatcttggctctgtgtctggtccctctctgcttcaatttctcctttctgcttacaattccattatgttgtgagttgcaattttacaggggaggtgctttgcacatagcactgttgtgactgttaaaatcaaccataaaagttgcacatttctatgatttaaaaaaaaatcaggataactcaagaggcgtttagagaataggcagaacattgacatagttttgctgtgtccccacccaaatctcaccttgaattgtaataatccccacgtgtcaagggtggggccaggtggagataattaaataatggtgtcggtctcccccatgatgttctcatggtagtgaataattctcatgagatctggtagtttttttcaatgggagttcccctgcacaagctctcttgcctgccaccatgtaaggcatgcctttccttcttctctgtcttctaccatgattgtgaggcctttccagccatgtggaactgtaagtccattaaacctctttttctttataaattacccagtcttgggtatatcttgattagcagcatgaaaatggactaatacaaatatgtgtatattttgcattaaaatacaattgattgtatgtttaatgtattaatttttgcattcttgctcaattgctaaaccaaagaaacattgaaactataaaaaccttgataaaccatggtttatcttttatgttttatttaggctctaacacgataaatgcaataaactttcagtatatacttttaccaaggaaaaagactatccactgatctcagttctcattttgtgtttctatggtagtcttcatgaatttttatagtaattatcttgagcagatgttttagtctcttatcctgataataagagatacagtcgaataaaaaggaatagtttaggagagctcatgagagtgtggtggcattcatgaaaatagaccaaacaagggaacgtttaggggtgactttaaaatgtcaaaatacatgtttaagtttattagaatagtggattatgaaaacattttcttaaaattacatttttgaagaaagataaatggaggaatacaaatataaacatttaaatctcattttgagtttacaaaaataaaccaaagcattttcattttatatctcaacctctttcgtagggtattccaaataagtttaaatagtatatgcttcagttaaggcctcaaagtaaggtgtaaattgtaaaatgtagacaatggttcatttagtctgttttataaatgttctgtattttggcaggtttgtttataatgcctagacctttgtgggtgagaaaaacaaagttatataaatgcaaagcaatcctttgaaaccatttatgtttgtaaatgtatgccaaaaaagatagtatatttaatatgaatacacgaagagaagcataaggaggattctaaatgtttgtgacatcacagtcaaaatctagctaagaaattgtcctcagagagactaaagaagaaaaacaagttgcgttggttcatacctacaccagtgatagaactacacaaatcacagtagtgataatcagatgtgtctgtccagatttaatgggatgcacacttggataatcaaagtctcaaatagttctatagtggggacatctggtggatgaatatgtcctaactgtggggctgctgatatgaaaaagtggaattcccatagtgctaggcagcaaaacttccatttctccaaatagaggagtataaattaacctgatatttagatatgtgcgtgtttaatgtactcctatatatactctgaagtaatgttatgcaaaacagttcttatccaatcaaaataaagtgtatcaatccaaaacaaaatttaatgtgaggaagagggatgaaattattttctgctactcttgtaagaccttaagagtagagtaagttcttataagtaagattcaattaaccttataagtaagataaaattaatagcctcaaaaagtggctggaattgacaagttatgaagttgcctgtaatagccattgacccaactttttatttgattttatttgcctatggtttcccagatgacttatgcctggaatgctgaagatttagcttaaaaagaagacagctcctaagggttccaattagctgagttgattaaagcattcattgaaagcaaaatcaaaaatttaattattccatattctcatagatcagttgctgtttgttcaatggctatgagccaaaacatgtcccactggactcatcaacaatgcatgtctttgtatttgaagcactgtgtggctggcaacatgcatcactgtgttgacaaacaacttgagagtgcctgtttcttgacttctttggaggcaaagccttatctattatttactgccttggcatcctcagttctccaccaagaagaaccccaatctagttcaaaagcagattggggtattggtgaaaactcatttcaattctctgttcctttagtcaaacttttgctatttgagaaagataacttaacctttttgagtctcaatttcttttaaagtaaaaaatagatagtaatactgatgtcaaaaggttattgtgagaattagctgaggtgatgtatacaacattcatacattcttagcatagtgcctgacagaagatgggcattcagcaactattcattgaataaatgttttcagccatggatactctgtgtgaagagaagtataaggagaatctccacagagaagcaaatgctattaggtatgaagtccagatgaatttgttttacatacctgcctgtcaagagacaatctggttctaatcaaaccagaagacaataaatggagaaaaattctagagcattgtttcttagatttgatatgcatagaaattacctggggatcttttaagaatgaaggttgagtctgggtgcggtggctcatgcctgtaatcccagcactttgggaggctgaggcaggcagatcatgaggtcaggagttcgagaccagcctggccagtatggtgaaaccccttctctgctaaaaatacaaaaatgagccgggcatggtggtgcatgcctgtagtcccagctacatgggaggctgaggcaggagaatcgcttgaccctgggaggtggaggttgcagtaagccaagatctcaccactgcgttgcagcctgggcaacagagtgagactccgtctccacaaaaaaaaaaaaaaaaaaaaaaaaaaaaaaattaaggttgtgattcagtgggttgagtctgagaggctgcatttccagcaaactccaggggatgcatgtgctgctatccactaaatacactttcgggaggccctagagcactcgaatgcatgacaagaaatactgtgcttagatctctatttgtctagaccaacattctatttcctagcacaacttaaaatttatgtatttatttaacaaaaaatgatttagtgcttcctacgtgtcgggcactattctaggttctaagtatgaagtagcaaccaagacagatacggataacaccctcatttagtctagtgatagtcagacaataaacatattaaccaattaattaaaatagtttctagtggtgattaaaagtataatgaaaataaactgaagtgactgggagagtgtgtatggtcaatgaaatctcctctaggaaggagaaaattgaactgaaacctgaatgttgaaaaacaggattctgtgtaagacctgaaattttcatacaaagtgaagagaaagtgcaaaactgctgagacaacaatgggcttcgtttgcaggaggaaagggaaaaaagtcattatggccagaacataaagcttcaacctaaatgtgagacagtgatcagaacagtaaaaagggacaagatcatacctggaagggttggggatggtacagaaatcattctaaaaccatcagggaaatctcagatgttggatcttagatgggtcttaatagctccacagaggattaagggtggtagaaggagtgatcctacaggaaagtacacctggccaagcagaacaagatgattgaaaaagagctaaaataagatatgggacacaaactgggcggatggggggcagggggagtgcggaaaaaagcataacttagaagaaaggtcaaaattgcacatttctttggtttacatgacaacaaacaaaaatgcattacttacgctaggcaagctaatctaatggcacccttgtagcaaagtctgcattgccacagaataaatatttttctgaatagaaaagattaggtaactattagaggataaataaaaatatgacgtttgttagctatagactttagccccaaacttttcttgctttccacagaatattggaaacaaaagtgagagaaggtagatggtacaataaaagacagcagtgaagaaaataagatataagagagcaccccttgcactaagaaaaagcctagtagaaaaaagagtcatcattattatgtcaagtgtaaaatattaaatgccttatacaataatgattttcatactctacctatgtacctatatatctactatctgtttagtacatttttttaattgggatacatgccaaaacccaacaccaataaaaacaaaatttgagagctcccacagattagagtagctaaataagaatgaataataaaatatttactcaattgcaattttaatgagccttctttacttactagtgagtaagtctaatgatttaaggccttgcaatgtaatggctattaacacgtaggtgcattccaattgacttctgatttttgtctcatgattaaaggctctgcaagctagtagctattaacatattagagcatttgcaatttactctgattttctgtcttgtttttaaagcatatgaataaaggagtgtacattaaaatgatgctcctaactccccaagtgagaaacagcttggactattttgttcagtagcctctgtaaggaatggcaaggtgagtcaccctttctcacctgaatgcctaatgcgaggcacacactttttatatattcacccagaattatgattatattctgtgccaaaatagcaggttaatttttgtttgattgtgtatgatttcattctgttctgttcccttgacctcgttaaccacctatattaatcaactaaaccatagagttcagactttttctcctaccctgttttggttattctgttggttgtttttggcatttattaacagcaacaatgttttgtttctcattggccttttatatatctcatttcacgcattcagcaaatattaaataagtgtccatttttgggccaatctctagagtgtcaagggcaaaatgagggagtgaagtgagatgaggctaggaagagaaacacagcgaggtcatttgaggtcgaggtcttgtaaacttgaaaaatctgccctttatcttaagagcaacagggaactaatgaaaaatattaagcactggagtgacatcacattacttctgccatttgtttgttttctattgtttccctccctctccaactgggatcaccttaagcagtgactttataatgttatcccatcatttacatttcctgtctatttccaactaacaaacaattttttacgaaagaagaaggttgccaattgtatgaaaataactactctgagagacacaagagagtttgtaaatagacacctattagttggttcatgaaaacatatgatagatgctatggatagagtcattatttgtaaatcatagctcatctccaaaaaagaaagaggggacatgctttgttgatgctccttattacaacttaagagtacaagtataaaaattagtacttaatgggcaggtgtctgtggcataagaatcgtctcagcaatgtgcttgatataccctgataatgaaagaagcctcatttagggtcatgagtgtatatgtgtgtatatatgcttgttcctggtgttctattaacatctggctatagtaggcaatccctcttttggctacgtttttttaagtaagagcaaaagaaagataatgtaacttatctgggtgcccatctggtttaaattgctcattttacattaatttaacaataatagctgttggtggtcatgttttccccaggagaagaagttgacagacagctgtgcagagatgccatcttccccatccctgtggcctgtgatgccccatgcccgaaagactgtgtgctcagcacatggtctacgtggtcctcctgctcacacacctgctcagggaaaacgacagaagggaaacagatacgagcacgatccattctggcctatgcgggtgaagaaggtgagtcgccagcttcagacgccatctaggttcgtttcaaaagttagtgtgcatcttttttgtgtagcctggaaaagatgatattctatgaaagtcaacaaccagaaattcagccatccaagatttaatatctgttgatgtgttgagcaatttgattctgtcccccaaaattaatcttgaaaatggatctctaacaaaggagaaagactttttaaaagtgaactcattttgctttttcccacccttccagtcattagagttctttgtaaaccaaagtgttaggcctttaagaaggtctgaaaatggctcccaaaatttcagatgtttcattgtttttttctgaatttcagaagtcagttttatcttttgaaaatcatattctaccttctcataaataagtatatatatccaatcataaagtttatttaaaatcacaagaatagctactgttcgaccaaaaattgcaattttcagtttctttgagtttcttgaacataggctccgaggtccagaaatctcatatgtaaattttgttcatttttaaaatatgttgctcctaaatctcttcaccctatagggtgaataaagcatgtttgtcacatattcagacctcacttgcaagctttattgccaagaaatacaaggctcttggtaattgtctctcaagatgatatccaaatgctaatttggcttctgtgtgactgggtaatataatgtcatacttaatcttgtctttctgaaaaataacacaagagtgagaaaagcataaaagtaaatcaagtttgttcatattaaggcatgttctttctcaagaatataagtgtatgttatttaaacattatcaagctaaatgactctttgttcacatttagcactgataaataattatttctatttgtaataagcataacattttatgttttccccaaattatcgatttggggggagttttgtgttgcctatactttttctatttttctgttcatgaagtattttagtgatagaaacatagtgttcctagtcaaatttgctatctgtgtgtgtaacaactgtgcacacctataattaccttggcctttgcacatgagtgttacatgcgtaaaacattttacacacagaaaagccaacctgtgtgaaattttagaattttctttatagtgttcaaaaactttttcctaccaccttaatatatatttaactctttgctccaaaaaaaaagtgtatctattgaaaaatacaaccttttacaaagaaaattatatttcttgtgttgtcaaacaatgactctaacctcgtgaagattgtatgaaggctttaaactctatcagctcagattttgccttgggcttcattaaaattagatctgtggtcaccctgcttcctgtaaattcattatactctgcagacacttgctgtgtgactactaatgaatgacttttcaccccaccccgagtcacatggcaaggattttgccatgcttgcagaactcaccagatcattattcctgtagacatgatgcttcacacggaaaggtcatgaaatgttttaaaggcagaaatttgtgattgctctttgatatgtatcatccactgagtttgaaagggtagggcttcaataatttttaattaagtttagtggttgcattataagcaagtcatgctggaaagttatagatgtttatatagtaaatcataagggcattaattcaaaacaatatagttctgttttaattgacgtgtaataattgtatatatagggtgcagtgtgatgtatcaatatatggataaattgtgtaataatcaaatcaagataattagcatatctatcacctcagacatttatcatttcttttagcaagggcatagagaatcctctcttccagctattttgaaatatataatacattattgtaaaacatggaagccataaaagaaactctgtcaatgctatttgtctctgctgctatttacctctgttaataacatttataaaagctggtataattatgtgaaatttatacttcaaagcctatttagtacctattagtggacactgaaacatgttttatgagaaatttgtacttcaaagcctacttagtacctattatttgttggacactgaaacacattttctcttactcaaaataaatctttcctaattctgaactatttttaatgatttaggaacagcatctgcaggaagttttaaaatgtgtttctctgccacttagataatcctttgtaattctacacaaaagtcagtctttccattattcttcaagaattagtgctttgtgtcataaatgttcttaaatttctgtggatcagacactgattgtgataactttaaaggaaagtgccacatttgagaaatgatatatgaagtgtttaaacaagaaattatatgattttctagggaaataacatacaggacaagtccatgcgaaaagtagatctggatttatgaaataaatgctccaacctatactttcacttatcttaatcagaatgccaccattaaacaatactgaaggctggataactccttgtaattaataaggatagactaggttgtgcttcagtaatggacagcccagacattcaggagcttaaagaacaaagctttatttacttcttcctcatggaaatttagctacagttttgggtaactctacagggcaatttgtccttcatgaaatgtcacaatattgcatcaccatatgaagacctggttccacaatcttcatgtgccagaggaagaaaatacttggagaatctatctgtcgattttaagcatcagcaagtaaattctcccatctaagagtgatttatgtcatttctcacgtttcattgttaatgtaagttgtataactatgcctaacttcaaggcgaatgagggaaatataatcctattgtgtgctaaaatgagaggagtattgactagtactcttacccctgatttactcagtgttcttattgtgtatcagtgtgtatatatgtatgtatgtatctatctatcgatggccccaatccagtagataaaacagggctcctaacattgtgaaaatgttaggattaattatttttgttcctcttaaatgaatgacagaatgatagaatggcactttctcttcctcatactgcacttcttttctttcttttccttttgcttttccttttgcttttccttttcctttctttcacttccttttattgctaggctctttttctcctttcctgaacaattctatccaaaaagccatttggtaaagccaagcagctgggcatctgtgccagcagataggaggtctgttggtgatctagagtgggttgtcagagcccaactgggtgaggagcaaccaaagtgggaaaagaggtggcctggcatgcattttcagagccagtgagcagggtgaaggacagggggcacatgggttgtatgagaggatagaagagtgactctacactggatgtcagagcatagctgggtcaagagagaattccagcatcaaggtggccagcccagtatggggtgtcacagccagacacagttgaggagtgtttctgtcatgtgggtggcctcatgtaggatgtcagatcatgagcagagtaatgaagatatcttgtgggtatagcaatggagataacaatgggtaatggagtgtgaagtgagagggaattgacaaaataagtacatgtatttaacatagtgagagttggtttttttattgctggagaagagagttgcaaatatgttaggaaagaaaactagtacactctgtggtacagcattggaattggatgttattaatttatttgaattcatggtgttcaatttgtaaagataaatatagaataaacatcaatgtaagtgtgcaaatataaatatgtacatattatatacatatagacatatattagcctcattcactgaaaagacctgagagcagcaagacctcaacagaagtaagtagctgcagcagtcagatcttggtttctaatactattgtctaacaaaaggaacaagggaaactttgagaaatggctgattccacagctgcaatagaagaagtacaagatgggccaggaggatcttgtggtagaaagtaaagagaattgtcaaaaggccacagaagccaacttgaatgttctcccactgaccacatttgcaaacaattttaatgacaaaataataataccaacagaccattaaataggaaaccatggatccacatattatataaataaataaaggaataaattcaatctcattaaaagcattgtagttatatagtctcaaatatttccctaatagagaagtctgacagacacccccttaatctggtgaccaaagttagcattatcaataatgaagcaaaccaaaatcttgtgtcctcagtatgatataatgagaatacgatatcatttctgtaataactctatcaaagatgcatatatagaatctagtcatgaggaaacatcagataaactctaattggaagacattgtacaaaataatctttaatcttccaaagtgtctaagccatgaaaatgaagaaacaattgaaaaactgttcaagatttaaggagactaacaaagtgtgacatctaaatgtaatgcttgattctgaactaaatcatcttgctgtaaaggacattttgggacagttggcaaacttgaatgcagtctgaggattcaatggtcataacttatctgtttatattctgatttttggattttgaatatttaattgcttatgtataggagaatgctcttgatcataggaagtacacactaacatagttagggtgatggacatcgtttcatctttttccaagtggtccaggaaaagaaaagtatttatatcatacttttaatttcactgtaattttgaaattagttcagaattaaacatgaaaatgaatttgtatataatcgctttctacactatctttttttttttttttttctctgagacggagtctctctctgttgaccaggctggagtgcagtggcccgatcttggctcactgcaacctccacctcccaggctcaagcgattctcctgcctcagcctcctgaatagctgggattacaggagcaccaccatgcctgactaattttttgtattttagtagagacaaggtttcaccgtgctgcccagggtggtcccaaactcctgagctcaggcaatctgcccaccttggccccctaaagtgctggaagtacaggcacgagccactgtacctggtgctttctacacaatcttgagtaacattatataatctattatcaatacacaaaaattgtcataaaattgctaattattgaaatgtcatttggaaaccaaatcacaagtactggcaactggtgatagttaatgtactggagaaggtaaaattagttctttacacttaaaaaaatggtgtgtgtgtgtgtgtgtgtgtgtgtgtgtgtgtgtgtgtgtgtatcttccagaggcttgacttctggttaaataaaagtgattcactttttaatattcttgccttaacgtataaatattgtataaactgtaggaattgtctcaaaaaatattttaaagttatgttaggaaattctaaagggaggcaacattttaatacttaagcctggcatatttttaatataaatagttgaatttgaacaaaaagttaaaaattaatgttagacttttagctttaccaattttttgaacctgtattgtagatcctaacaagtttcatttaaaaaggaaaaggttattttttaaatggttcccactgggtatacaatttgttaactctcatgatatagttaattattcttacagagcaaaaaaaaaaaaaaaaaaaggaaagtatttatttttgttaagttcaatatgacctgatagaacttcatcaaccaaatattaatgtctttgcacctgtcttatacaagcagagaatagatgcagatggaaataaattatgtcatttttttctcaaataattatcttcagaagtcatattttacaatgcaaaacattgagaagaatatttttatttaacttgttcaatttttacagctaaatgattttaattatagtaaccaggtagtacccatattccctagaaaaatttgaagaatgcaggattcattacatgtatgcatatatatgttatatatatgttatatatgttatatatatgttatatacatatatgttatatatacatatatgttatatatatacttataaccctgatttctaagtaaataccatcacttccccattctcccactattgaccttgaaaagagagttctgcttcaatctgtcactacttgaccaccacacaggacttacgcaggcttcacggtggacagtcttctgcctgtttctgcaaagaaaaaccgggaggtggggctgtgctgccgcagaatctcctgaagtaccccacagctaatgctgttccaattcggtacccccaaagcatatccttgccaatgcacttttcacccagcagtggtctgctgtcaaaggaattcaggctacaatagcaggaaacgttagaagcaccttaaaagtataatttatagtattatgataatagtactcttcacactaatagcttctttataacataagcccagtctactttcttattcttgttgccaattactttctgatgtgaactctacactccaattgactatgtcaatattgttaattgccaaggtcacacctgcctgcatgcctttgcttctgtttatttatttttctacttagatactattctcttttccttctgtcccttcccagaattctgcttattgaaatcctactccttcaaaatttttctcagtgcctctttcaatctgaggcattcttcagactccaaaaagtagtgaaattgtactccttgaatcccagttatactaaataccgcacaatataattatttcattctatctagaattatactcatttgtatccttatctcccctactacttttccctactacattatgagatccttgagtgtagcagaaactatttttaacccctgtaggtatcccttgaagcatctcacataaatattgcgtgtatttatgaacttgatgtggggaagaaaagtcactttttatttctaagccatgttaattccaaagaacagagtatggtaaggttcctgttggcaccgtatctaatttgctatcattgtccatgtttttaggtggaattcgctgtccaaatagcagtgctttgcaagaagtacgaagctgtaatgagcatccttgcacagtgtaccactggcaaactggtccctggggccagtgcattgaggacacctcagtatcgtccttcaacacaactacgacttggaatggggaggcctcctgctctgtcggcatgcagacaagaaaagtcatctgtgtgcgagtcaatgtgggccaagtgggacccaaaaagtaagagctttagaatgacaacagtaaatcgtgtagccacctgtgcagaggattggctcaggcttcactggcttcatgaaatggaacattttgatgcttgtcatacctgtcctcaagagcaagatttgtttgttttgaaagtcagccactgataaagctataacagctttgagttttatactggggaaccataaattctgtagaaatctttctatctggtgcctactctctgttttatagtagcactttctgcttttattaagctagtgaggcaatgaaagaagtgcttgccgtaagcctggctgatcaataatgacagtgtactaggtcctggcagtgtaggtcatccatgacctcctatatacccgtaggctacggaggctgcccaatctagtttaattgggtagaagccttgtatgatctgcctttcatttcccctagaaaacactatatcaaaaataccgaagcatacttactgcgtctttcaatggttagagtaaaaaccatttacttccaagagagagccttgggataggatgagtgttattataagtagaaaaactatcattttctcagggtgcttttgagtactataataacagggcaaacactttgctggaggggagaacaaagaaccagagagtcgacatattatatgtgccttgtgagaagtataaacaaaaataatggcataactgagctaatcacttcatagagaaaattaataaatctactctaaaaaattgaggggaaaaagctttatttttcaaaacttaacatactttttaaaaattcaaatcaccttagccatgtaagatatgaaatgataaatgagtcgatttttgcatgggtttaaaagtggcctcatatttactaaatactcagccaagtggttaaatattgtgtgtaatcttcagcgtgctacctaacttactctggccaacagtttttgcagtctgttgaaaggatttaatgaaacatataatagtaatctaagcactcaataaatgttagaaattggtctttttcttaagaatttcagctactccttagtgttccaagaaaatgaaaataatgtctctgatgcatgaaaaactccagggaaacaaatatgaatcccattatgagatgtttgtgtctggccagggttccagacattagggatattttgccccacaatttatttttttatattgcttgaaattaggaaacacagaagacatgccagtgagatttgaataaattgaaagactatttcacatgtttaataggtaacctcaaaccaatattttaatagaaattttgctaaagctgtgatgaatctaactcaggaaattaatgtacagtgtattaaaattcaaaagtggtaacagcaagagcagatgtcccaagtcctggaggattctgactcttgctggatcaagaacaaaggtagaaatattcactacgcaggcacaggaccaacctgttgtggcgcaggatgagggttattgtgctgagcttctaccagtgagctcattctgttcctgtcccacggttaatcacctttcaaatgttgctgttttgacattttcctcacttacataagctacaaaatatttttcctgagtaatggatgtacatatgtacacgcctatatgtgaaagagcctgctggattaacagcattaaatcagtgggaagggtatcctgaagccccatgtgatactaccacaataattcattaaaaatttgcttcacccttgcagccttcattcaatgacttatgtgcatctatagacttgttaaatcaaatggatgtactttacctctcaaattctagaaaatcaagcaaatactgtgaattcaaaagaaaatattattgcctttctccctacatgctaggttaaattcagtgaattctttctaatactaggtatatgaaccaaaaaatgcaaattgaaaatttgttttaaacttctcttaataaaacagattactgtgcaatggtaaaatcaatgttattgatcttatctgtcctcccggtaacaaacttcagttcctatcacatctgtttaatttgaccttgaataagatttggggggaaatcaatttcttgatttaaaccacaaacactaaatacaaacagtacaaaggataaaagaagcctgctgactgaaccaattgccttgccaaaggaagtccaaattcattttattggatgtaatttaggctgtataatttatctttgtgtgttcatttaacaactttgttgtttgtaattttgttctccacagtcagccaagtatcttgctgtgactatttctcaactaaaacagaatatttggaggttgtcaatgataacattgtaaatttcattgatttattcagggctaatatctgaggagcatgcaactgagtaatgctctctcattgttaaagttataaaattgccttattgaacaaaagtgctgacaataataattactgaccaataatttcatagttccaaaagaattaactgaattatatgtggagttttgccatataatgtttcctggttaagaatgcaggttaaattgtaattctactgatttataatctaacatgtaataataaatttgcttctatgattcaaatctaaatttatttgttgtccgtgactttgaatagtcatagaaattagggaaattccagcgcaagataaatcaaaaagattatttttgaaatgttgaatccttaaatattttaaaatccacttccaaataaacactggggttttaaagtaagagaggagagcattgatctatataattgaataaagcatagtatctatgtatgaagaagaaaatttacataaatacttataatacaagatatgtcaaaaatgaagtatcagcaaaatactataaagaaattatgggaaatagattaatgatgttgacttttttcactcgtagttcacttctgaaaacctgattaacttacttgacaaaagacaaacttgagctacaaaatatttgaattctcttatatagagtattttaaaatcctatttcccactgatctgccaatttattttagcaagaactatactagttgtttagattattttttcattgcctgttagcttacatggcagggatttatatgacttcaaaagagaattgcttaggaatcagaataagttatttgttacttttaattatatgaatgatattattatattttacttttctaagctacatctttttctagtgttaaggctcattatcagcatttgacctctagcaatagtagcatcagattgtaaaaatgcagagaagaattgggaaatttaaaaattattacttctcagccttttggctaagctcaagtgtaaaaaattatatactaagtatattttgaataagacagtatatttaaaacctatacatcagcttcctattatctcttaagaagtgaaagcttatatgaagttagacatttcagtgttcttcatccttatctttctgttgtgttcccaataaataatatatttttgctgttattttgaaaatagtagttaattttactataatttatgtcaaaaatacagtattttagttttctttactgatttactatctttatttatcttcactgtttttgtttcaaaaaagatattgtagtttataaaaacataaaaaagattaaatcccatcatttaaaactagggactaatggaaaagaaaacacaaatagatgcactaaataaaagcaggaataaagcaaaaactgcttatcagattgatttatacagttttattatcttaattattattaaatatgtagtttttaatacagtattgtgttttgagcatgtactgtgtaaagaacatactccactataaatttattttatacaatacatattttgtaaaaataaattgtagaataacctggaaacttataataggcaaaaggcctagtcatacaaatatgtatcatagaattagatccttaaattaataatttaaattttcacaaaatttttcttaaaacatattagaatataaatacttattaatggagagattataagaggataaggtataagtgttatatttgtttctaaatagcattattggtattagtaaatctgcacatctttccttgagaggctttattgaggtccggtttgaaacaatcaatttagttgtatagttcttgcctgtagcagaaagaaagactcctggaagttaaataatacagatgagtgacttgttttgcaattttaccagtgaaaattctagagaaattaaattatctgattttctgctttactattgaagcctaataattcccctttgcctttctagatgtcctgaaagccttcgacctgaaactgtaaggccttgtctgcttccttgtaagaaggactgtattgtgaccccatatagtgactggacatcatgcccctcttcgtgtaaagaaggtatggtctgcagagttaggaaggctgttcacctagaaaacctcctcggtagacttctgaggtcttctggcctagcaatgtttgtgagttttgcacagggctatgtaaacctgatttgacatgcatgccataaaatgttagtttccctctaggaaataacatagctttagaataccagacaagtgaggtttatgccaaaacctggcttgaaattttatgatatagattaaagtgaaggattctaaatcttattgtattaatagtgtttactttcacattagttctgaaggaatatatcgtggtatatgtatttcaaaatgatatacagtgcttttatcagtacacatggctttcatcctacttaatggcaaaaaataacatgggaccagatttgctacagattcaattatgcagccccaagaataggaataaaagaaagagaaaaatggccaaattgtttctctgccagcatgtaatgtgtcatgaggaatttatgaatatttattcccagtttggcttagttttgcttttattacttacagacaaagactcgttagtatcaagccaaatactttgataattctttcttcaccctctaggtcagggtcttttctcattgctgatgagaaaggtatcaacatcctccaggtgacttatgcaataactgagcaaattttcctgcagtgttacaaatgacgctgtctcctatttcttatcttactcaacaaatacagataattttttctaaatttcctgtatgcttttatttttttcatgtttcttaacacttactagagagattcaattaagagtcaacttctagcttaacaaactattttaagttgtcaaaatttaatcaaatcctttaggtattatacatttaataatggatacttttactgtgttactatatttttatatagttgaaacatgattttccttttgatggttttctatttaatacccttgaaatatccaataaaattaaaccacacttagaagtgatagaaaattattattattctttattttattttatttttaagatagagtctctcactctgtcatccaggctggagtacagtggctcaatttcggcccattgcaacctcagcctcctgggttcaagcaattcttgtgcctcagcctcccaagtcactgagactataggcacatgccaccacacctggctaatttttgtatttttagtagagatgggtttgtgccattttggccaggctggtctagaactcctggcctcaagtgatccacccatctcagcctcccaaagtgctgagattacaggcacgagccactgcaaaatatttttatttaggagtcttttaagacatttaaatagcttttggcaaattaaaaggagttataagcattaacttttataaacatgttaatggcatgaacttgctatgcagtgtcattgcctgacattttaatccagattttcctctcttattcctttttttttttttaagctgaataacaccggtcacagttggcagtagaattgtactttcttatagattaatattttacctatgatggcacttataggtggtaattgttggttattaattaattcaattaaaaagcattaattacatagaattaatacacttacaaattttgttcttgatgcctttatacttgatcttttctgtttatatggaatatgttcatttactaataattccaagcatgtgcagttacatttataagcaaattgttaatagtctaaaacaaattttaagtgaaaattttgaaagtggaaagactttgcctttcccttattttggatattttcttgtattgtgtaaattactcttttaaaaaagttgatttgatctaaagtatttcaaggaagtaaagtttaaaaaagaacagaaaatattttattaaattgattccagagtagtcactaataaaagtgaagaatcagaatttttctcatttctttagacctttatttgaaaataattttggatattggaatgtatccaggaattaggaaccattttaatagcctataaattttttcttaagttcttgaaaacacatttgtgattttgttacgtattatatacatctggaaaggaaagaaaaaatagaggttttttaggagtaaaaaaccatacttgaaaagaaaataacatgatttttaaatttgtgatttttacagtatgaagaaactgatttgctctttgctgtttgatcatttataaaataaaaaatctaaaacactgtgataactcacataaagcacttttaaaaacttcttagcagatagatgagaatgaatagattgtgaatgctacataggtcttaattgagtcagtacttatttgtgtatatatgtataaatacttatttaattacttatttattgatttttgtatataactagcacactaatggtcatatagagaaatcacagtcccagacatcaaggaagcttttaattgcatttaacatatagaactcttctgcacagcccagataatgtaagacttacatggttcaataacaaaatttaatggtaaaacacaaagagctctaaggaagggaatggaataatcatgtcagagcaaatatattaagaaaaatcatactgaaaaggaggtacaagagatcttcttgaaagatgaaccacatgaaagaattgcaagtgaggattggagacatcaggaaagccttaaatgactgtgagaaagatgtgattttggaacgaccagcccactggagcccaagatgtgaaggaaactttcccagaagagactgaagatgagagatcatgtgttccagtgggcgcagcggtagaagggctagaggatgtaaaggaatgaaaaactgaatcgtgttatgcgggtagatagtgctgtgggtccgggtgatgatgaatgacctggagctggggagggctcatttcttgtggtgagtggcaggcatgtgaggcataatgggtttagttgggttggtctcttgggggaaggtaggaaacctctgtaagtaaaaatgcatggtaccactaggatactattctctcctggtgttcctgagatggtggtggcaagagagtgcaaaaatgccaactcgggaatcggctctcttagaagcaagaggctctctaagcggcagagcagtgtttccctgaacacaggtcatgtcatccggagcaaggaatgagtgctgactgttttatttggcagctcatgttgtttctcctagaacaaaaggttttcagaaaccctaaacctaggcactccgatttttaaaaaatcacctcagttgggtatttgaggaaataaaaattttttaaagactggagagtgatagaagggtcattgttggataacagtgccaagatgctttgtgctctagaagcagttttttctgttttgcctgtagactgctgtaactgagaataaggagacaatggtgttacagaaagctagccttttgttgtgaagaaaataaagtaaatggcatgaggttagtttttttcattatttcataagaaatggaaataacccaagtatcattttgaaattacaccaatttacacacaccatttaaaaatgctaagcaaagttgaatgttcaaagagaggtaatagcaacagaaaattaattcaaagttggggtggttctttttacttaattctgcgagtaaagtctaaattttacaaagatgttgggcttattaaagtgcaggactatccttctttttaaaatcactttaaggaagtcaaatacacaatactattgcacaaaataaaacagaatagtaggattccaggaagaactaaaagagttgtttgaaatgttattcagccttcttctaaaataccccttgaaaaatcaatgctgataaagatcagtattaagtggagtgtagtttaatcctgagaccagtgcacttgctaacgtgtttttcaaatttttgtaaattttgacagagggcattttaaaaaatagaaataccttatgcacataaattatttgtacctctaattttaaaaaatcaatacttttgatcaaataatatatttggttgctcaaattctgtttgctccttttttttctcactgcatttattgtgttgagaaatagaaggaatattgcagaggcttcttcctcatgtcctaaatcactagagcactagaattaccaccaaagatctgaatactacctttacattttgcttcttggatgagacatttccctttcaatttcctattactgtactgcttcaacctgcaatccatcccatatccagtttaatgaatcagttttgcctgccttttaaatccttttcatcaagtaatttctcggtgaaatttattttgaatgtcttaagatatctgaaaaaatgctataactgtgtgagagattacatatcttctgaatctgtgtaccccatcatcacatgattatttgctagatgtacgatctgttttttccattcctatcctggataggcatttttaagcacaaacgtcacaggcaggtgcccttatttttcgcgtacttgttatttccaatgaaaacaaagtgatagcttatttttattaatccttaatgcacagcattggtacctgtgcgcttaccactataaaggaataagtggaaagaaatagaaggtgctaactaataatccagttgagaagatgtgaaataaatgtgtttgtgcgttcagcaaatatttattaagcacttactatatgtgactcttgtcttaggtataaaacacacagatgaatagaaacactacaaatatatcaaccgcatataataaaatgagcataaatacaagcaggggatgatgaaaggtataaaattcccagtttgccagctcaagttattaatgatgaaactttcattttttgtttttaatgtgtgctgtatagcttcctttttttctgctctctgatctgaggactgtataacctggcaaagctctacagcgctgtaactttgagtacacaagcaatttcttaactgcaatatgagaagaaacagacctgccaatgggtaaaaacatagatgtcattgacacttcctgtgtaaccccattaaacgtcttctctgggtgtcatatctttgaagagttccacttgaatcaggtcacaatctctatcctgtaggctgtaccaggttaaggaatttgaacttttcataagaataaatggattgccactctggaatccattaaggacgtgaagagagtcatcatagtcttatatatctagtactaatttgtggagtttgtgatgagaaggcattaggagaatgtttcagaaatgtattctaagtgacattttttctttcaaatcaacaaacaaaatagaattgaaacattaatgtttggtagctgcttcctcaagtagaacagccctggctatgcaccaggtgccatctaggtagttaataagtaggagctttagtctatgaggtgccactaatgctgaactcattgtctccaccagcccccaaatcccctggtcttaatcctgtgtctgtcctctatctgcagattggagagtaattgcctctaagaattttgaccaactgggaaacaaaaacccatttgagccctttacgtcttacctccccattaaaaaacaaaacagaaacctccctgcttcccccaatgttaaacaaatgtgagtctaattagtttgtatactttaaaaaaaaaagattatggacagttcatacacataaaacaaaagaaaaaaatagaaattgtaaaagaagggcaaatccaggtagtgaataggaagggggtagaaggaagagggagagaaaaattatgctagaaaatcaaagctgtggcaagctccttcaactgagaagaaaattagctctgagattctggtgaccaaagcaaaaaatagaagtacaatggattctttacagattgtcaagggagacagaattttccctagctctgaattattaaaggaatttatcacctgggccttaaaatacaggtcattttgacaatataatagatggagactgcattagcaatttattaaaagtcctgttgacatttcttagatcttccctagataaattatatttaacatgtaaaagttgcagctggcattcaaactactgctacaattaaaagtccatgacaatattttcaaatactttaattctctgctgcccaatacttctagcccccaattccctactccattacctgtagtatcccgcttattcattaaaatagttatgccatcattaatagtacagacgacaccccacaacgggaataataattctaaaaagttacatgtaagcccagaatcttacattgggataggtcatacaaggtcgtgtattacagtagatttcaaaccaggcccttcatcccaaatacctggcaagatttttaaatatcctattcccaaacccagcttccagattctgatttagtagtcctgggtataggcccagaaatttgttgttgttgttgttaaagagattctcctatgaagtcagccatttactgatccattctcccatccaatacagaaatcctctctaaacatggcagtgagtcagttgcccagaccgtgttgaagaatatctttgactgaatgagaaaggatattccattatggcaatgttctaatcatcaaatcatactttctccaccaccacagtatcttttaaaaaggtttcatttgatttctgattaaacattaattgttaggagctgctaatcctttaaaatatttctgttcctgtagtctatgtatgaaatatttgaagatcttgcaaaataatgaaaatgcatcaggaggattctattaacataattctttagagaattattttgtaagtaaaaccctgtgccatgcagctattcatcgttaaagtgtacgtaatcttaattgaaatatattttattaaagttggcaagttttatacgctacatgatctgtatactaaaagatttttgaatccttacatcagtcatactgtcaagttgatgtctttattgaaagtgtatcttaattttttccatttttaacatactttagagttacttatttatagtaattattgctattttgactgcttctctaaaaagtctgtgtctgcctctaagaaaccactttcattttactacttagatccctaatgtttagaatgtgacctgaattgaaggtcttagactgtctaacatgaataataaatgaccggaataatttacaagttatgcatttcaaattaaatgaataacaaagaaataaaatttcacattatagcactgaatatattctcctaaagaagattcattacatgtgtatgagtcccatgtgataaacagggctaggcaaaatagcatgacaatgaatttaaggtagaggaaaataaattaattagatctgtcatattcctcaagggaaagaattatacaaaagagcaattactttgtgactgcaccttaggaaggctaactgcctacagaactgttttctccattcttcacattttctctatttttaaatatgaattgattgggtttttgatataaatggtctttgggagaatttagtgaatgtttagaccaggtgaagcctctcagggatgtcaaagcacatgtagctggaggcaatgtaatttcttcacacagactggtatttagagattatctcatcagtgtaaagtacagaggttaaaaaactgcttcattgcaggggactccagtatcaggaagcagtctaggcatcgggtcatcattcagctgccagccaacgggggccgagactgcacagatcccctctatgaagagaaggcctgtgaggcacctcaagcgtgccaaagctacaggtagggttagagaaatgcatcgtgagggaggagctgaacaaatacgtcaactccacatcctttcctaggataaggaaaggaagtcaacactgttccttccacaggctcaatggagttgggatgtttatggctgtagctgccattcttgtctcttcagcagagctgctgtgctactgaaatgatgtacaagaaggcaaatatttgtgtaaacttccaaggtgacgtgttagctccagtagtttggggaaatgtcttatgttgatataacatacaagaaatgctgaaaagtgattaataattatgaaacatgtatactttaggaagaaattctttttcacttagaagactagcctaagcattactcccctgctccaaagagcacctgtttgtaatcataaatgctcacattctggctcaggaaatgacatctgtatctcaatgatgctggtaagatggctgttctgttcatttgtgatcacctcaaataaaattgtagttatcgaagctatatatcatcttgataatttgttagagaaattttacctccttatgattaagacagaaattatctaatagaaatctgacgtatacatttgcagtcctgacagcaaatgaagtattatggcatcaattaatgaaaaatgtaatcacaaaataaatatttaagatgacattgtcaaatttggcatcttaatatatcaatctttaattctgagatgacaaatactataattgtatacttacaccatgcacattgacaactactggttcaaacttatttatttttggaatttgtttttgtaaagcatattatacttacagttgctgagatactcctacaatgctaaccaaaagagcactatacaaaagactcatgacttgaatacagtttcataacttgaataaaataaatatacattatttaaatggcatgcatcacttctggggccatctggtgcatttgttggcagtcctaatcattaaaaagtctaaatgttctctgtagagtcctatagaacttgacaatgatgtactcttgtcttcactgccagagaaagtacttttatatttaatgttacttcttctaaagcctagatggagatctaaattaaatttagatagaactgagcattgctaaataactgtgtttgcagtggtcaaagtcatgtttccatgctgctgtgtctctgtgatttgctggcatttttgcttcttccccactgggcttctgttcctgtcttgtaggtggaagactcacaaatggcgcagatgccaattagtcccttggagcgtgcaacaagacagccctggagcacaggaaggctgtgggcctgggcgacaggcaagaggtgggaggccccattccacagttcatttctccagcatcgctagtttaactactgttttgatgcatttgccacttggacaccatgcttagcaaacagagcaaagcagatataaatctgctatgagccattccacaaaacatcaggacatagaaacatgtctttttaaattgttcccattgttctttggcattagctcataattcttgaatttttctctcatttatgtctgaaagaaagtcaggccaagctttcacttatgacataaatggtacactgaagcttttttgtttgtttgtttgtttgtttgtttttagattacggtatccacagcattttgcttgccaccgtaataagcaataagattcttacctccttgcctatatgcattatatatgtgcatacatacaatgtaatagaattagttaactttttcagaagttctcagaatgacatctctttcattttcatggctatccacaattctgttcatatttagtactgatttttaaatggcagacttatttacttaattacaatctgcaccactaaataacgtggaatcttgcagaaatgggtaatgagaatgttcaactttgccataattatttactagatattatagggaatatagaaactcaagatttggaatatgttgtttcttccagacatagcaaattcagtctttaaagagcacatgattatttttactcatattgacttatagcatacagctcctgctgcgtatttaaaatgtagcataatacataattgaatatgcgagcaactttaatttataaaaaacgtattttgctctcccatgtgtagttacgtatttcatgttgacacaaaaatttgaagatgtagagcagaattccagtttttgctgatttgatctgggacttcattttctgtacagtgaaaaaaaactgcctttttaagaaaaaaatgcttctgttttgtaaaaaaaaaaaaaaaaaaaaaaaaaaaaaaaaaaaatcccctgtttttataatcttccttttagaagtcttcttctggaacataaaacttagtttccaaataatcttaaattgctagttgcagtagtttttaggattttattttatttgcataattctcattatgtatctcccaccatcaactttgggtaaaacataactgtgactccctttacagttatagagacttaagtatatagaactgaaagtcgttctcctccatttcaaatcattctttaagaaattgagtgatatgagatcttcttgtcatgccctgctaactccttcttgaatcaggcattgatttgcatatattttgggttctatatagaggttataatgaaaatgagcatgagtttgggaatcaggaaacataagttttagtctccattcttttactaatacagtgtgtcttactcatcccttcaccttctggacctcaatttatttagattaaaaaaaaagaggggtttggaccaaatgatattttaggattattcaaattttcataatagatgcacaaacaatacccagagatcaaaatgtgaaataaaattaggtaaagcagatgaaaaccatatctttataaaacaccactggaggaaatacaagatcagtagaagcagcacaagtgtgaaaacagcctcagttccaaacaatgacgtataagctgcacaaccttggatgattcatttcctccctttaaggctaagaacacaaaagccttagagtagttggcacatgctgtcttcattaaacgttaatttcttccctcttcctgtttgttcataacccaagtgaatgtatgcatatgggccttttgggttttgacacacaatctgtacaaaaactattctgtctgtgattaccagcaacctttgcatttccaaatcggaaaactgttcgttcttcatcctgggtggccaccttgtagtagtgaatacttgttacccactccctctgtgataaaagggtctttagcatcttcagtgtgcgactttctcctatctttctgattgttccatttttgatttcctattactggtgtctctttctctgcctgtacttacatagtgcttcctaatcttggcatatttgtcaaacaacttgctgtacctcagcaatcttatccattttcaggatatctgggaagtgaaagttgcattataacaagtgatatattcataaatatatttagaacaatccctttaacttccatatgaagacagtctttttctttgtttcctgagtagatgaaagactgctttttcgtacagcttatatttctatagaaacatgaagtggagaatcttaagaatgtagaagtatcttttactaattgcaagaagacaaaattttcttcctttgatggtcgtggctgttttcagaactccatattatttactcgccaagttcttgctattttcatctttatccttacttatatggtcagagacttaaataaaaaaatgaacttgtgctatttttatgacaaaaataattatatagtaaacattaaatcaatcaacaaagactatagagaagctgctctctgtcccccctagcacatcagaatttctcatttcaattactcattccactgtttttgcatttggaagactgtagaaaaagctataaatgttaggaaagaatgaagatctttaaaccagagagcttatattttttaggaaaattagatcactgttaatgtcacctaacaagaattaaagactgaaacttatcaattgcaaagccaatcatttgaagctgaagagctgaggaaagacttaaagtacgggttgggacttgacttgtaccataatattagaagaagtagagaggataaaagaatacaagataagatcaattctataagctaagtgtttgaggtaagaaaaacaaaaacattaaatgtgttcacagaaaagtgggtggattgagctctgaagatgtgatctggagcctggggtgattttgtggaaggctataaatgtcaagatcagtattttagaccttgttcgataagtggtatgagcaaggacctgatgaaagcagtgttttatctgtcagcgtgtacagaataaattagaaagataagacacatgggcctgaatgccagctagtatgctgctgtagcagtgcaaggttgaagtcatagaaacaacagtaatatgaaataggcaaaaataaataaattgtggacatacgatagagggaaatattttggggacttagtagcagacaatagaagagagataaaaataaaagagtcaaagttgatcatatgactctttaactctaacatttttaatttaagaatagttatattggtgaaaattctaggtctaaaagtagagctaattttggaaagtatattttatacagtttatatttgaggccatggcagggttagccaagtggaaatattcaggtatgcacttgaaatgtagaaatgtagctgtagagatagcataagatggcagatggaaatttgggtaacatttccatagagtgaattgctgaagttataaaaaagctaagaactctaaaatgcaacttttattatatatatgaataaaagcgattataccttatcattaatagatttcttttttctctaacaagtttgcacttgtagattctttaagcatttcttttaaagaatttaacttaaatgttattaactttaaattattgtgtccttgtactcccacttgaataatatcatgtaactaagatatgagatagctaactttaccattgtatgattctagagatagaaatgtttacttcatgacttttatcaatctatatgtccataccaggagtcagtaaactatatggcctgtgagctaaatccagtccgcagcctgtttttttgtaattagttttatcagaacacagccacagccatttttttacatattgcctatggctgctttcatgatacaaggcacaattgagtagttaggacagacccatatggcctacaaagccaaaaataattaccatgtagtcttttacagaaaaaaattgctgacccttgatctaaacccaaaagccatgtaaccaatgatgtagtcagaacttctaataatactgaatagtcattacccaataggatcagaaaatccctggaatttatcttgtcagttgggaagatgtatacaaattcaattcagcaataaaagaactattttatagttatgaaagtagtagattttaaagactgggacaatagtaaaatatctgcctttaaggatgaaattgcagcattctttttgggggaggttaggaataaaatgttgactctaagaactttagtagtaaaaattaaaattaaaaaggggctaaaggtgaaaccagaaaatacatgggctatggaagacaagagagaaaaacattccagccttcaaaattcccttgtctagaacatgataaattatactcaaaagctggacattcagagttaatttactaagtacacatagaaaagagagaatgtgtgtgtctcatataatatgtgccattcagcccaacacttaaaaggtcacctattatgattcagttcttctccaacgtctggacccttccatattgatagaaaaatgtaacacaaattccttcttatcaccttactagccatgcctcctaggcctgcacctacttttaaccacctgttaacaataaaataaagtggcctttatagacatactttcatttttactcttaatactattaatagcataatttttcaaattggaggaactatctgtgatgacatatttcaaaagatttgggaagcaattgtgttcccagagcctctttaaaaattgtaaactgtttacttatgatctcagcactgacattcgctctaaagcaaatttgtgagaatcatccttattcagaaatgagttaaagcaacacaggaataagaatataggtagagtctcttctaatcaagtaaatgcagtcttgataaaatctatattttatatatgtcaaaactatatgaaaagtttttctgatctattatattagaacacaaagtactttaaaagaaaatttatatattcctgaaagtttgaaaagcacataggaattttttatttatgacccaattcctttacatttaaaaggaaaagtggcataatgctgaagcagaattttatatcaattatccccagaatcaccagtaatttttgcccaatcttctctaaattgaattagctactctgctacataaaatgggtattttctttaagttcatcaagtgtttctgtagaaacattagaaatcttttctaaaacaaatgcttaaaatgttgtgttgatagttttatcaggattcttgggcttctataacaaaacactatagatcaagtagcttaaacaaaaatttatttctcacagttctggtgcatgtgaaggtcaaggtgccagccaatttggttcttgacgaagacctatttcctgacttgcagacagtcatcttctcactgtgctgttacatggcagagaaaaaacaaggcagagagagaaagcaaggggagtgagagagagagagacagagagagaaagtgcactcaggtctcatctgagaagggcattaatcccgtcataggaacctcacactcatgacctcaccttcaaataccaccatcacattggtgatttcaacatgtggatctgagggagatacaactcagtatatagcaatagtgcaggatccgaacttttaaataaaattcctatcatcttagtgtacagagctatatgtttgttaatattatgctctttcagaaagctgtgaaaacaggtaactcaaatttctaaaaaccaatccaaactttctgaatataattcaatataatacattctctcataaatatttattgaatgcatgctacatatttcacattgccttcatggtactaggcccagcctcttgagatattaaaaatgtataacaaatagattcagttaacttagtatggtagaaaatatactataggtatacatgacttgggttacaagtcataataatacagtagtagtgtatatacacaataatcactgaagaattgaaaaaaaaaaaagagataaccactgatacggcatagtgaaagagacacagcatttaaatataggatgactcaagcaaaaaggcaagaagtaaaatctttatgtttaggaacagctcattgaccagtttgcctagggttcctgtgagtgagttagaggcaaggggcaaggatagttttgtttttctttttctcattaaaaaaatgagaagtagtgaaggatttttacaaggctttgggtattgagaatgttatattccaggaaattttgtataatggcataagaagtaaaaagagagaggaaaaagagaaatttttaaagaagacattgacacgatttggcaactttaaaatttgaatcattcttaaatctcatatggaaattttagaggatctttgaaataggcatcttccctataaaattgtcaataaaagagaaatgcaaataacatgaagtatggccatatttcattttaactttgaagtgaatagacagcttatattttcttcatactattcaagtcactagtgtataaactttgaatagaactgtaacctccactgtcttttctctctgttcatatttatacagttcagatggtatttagaaggctgaattattggtcagtggctatgtaattgaaacctagccataataactatggatagaattgccattaaatttgcattagaaatatatgaccataatgtcaattttggatgctttgtttattcttttctttacaactgccctaagaagcaatgtcaataactacttcttcaatgtgtatcattccagtgtttattactttgtgacatgtttctacgaagagtagaatttttaaaagttgcaaagattcaaggtagacatatcacataaatgatggtaaattttctcttgctcaatcttcatgttgataatcatgccaagtgtacttgctgtagattagatggaactagagttaatattttctagggtctaccccgtctagcctaatctaatagcccctctgttttcttgcctgccaaggaacatctgttgtaatgtcactggtcactaaaatctgacatcagtctctttagatggaagccaacataatttggatgcattcttgaatctagaccacaaaaaagaaaaatacttcaataatataccttgcataggagaggtcctcctggccctaggagtcctcaccctgtgtcacttattggtttaaaaagattacaaaaggagagtccttaaaaaaaaaaaaaggtaaaagaaaaattctaattctcccctattaaacttaaatctaaatgtggaatgtgcaatacaataatttaactatattttatgctcttattttttgtgaacaaatatgcttaagttacatggtttaatctatgttgatgggccttgcttcaccctttgctgaaaactctgacccactttgctctttttttaaaggttacattttagaggcattattgaggttaggctcataatatctgggccaatttatcctggcagggcacattatctgttaattgtcaaaagagagttcttcaatagaaagaaaaagaagtggaaaaagaactaggtaggaaaaagagaaggagcttgctttaaggaaattttatacagacgtaatttttaatctcttttttggctgatatatttattagttattacccaggttttatactctgcagttatatataccattatttaaaacttctagaattatttatattttaaaatgtttaacttcctatgaatattagcatcctcgttaatttggggttttgggtttcgttttatatctctctgggagatctgtcataaaatgcttattaacatttgccattttttaaatagtagctcataaaataagcttggcaccgtgctgggtctgtgattgttcttggatgctccatgtgttctgatgcagttaacccttcccagatcccaactggggatcttagccaacctcagtctcagctactccactgggaactgattattatttcctagtaagttctcatcctagtattctcacatatattataagcatcagtgagactggggatcattggtaactatttaggatcaatcaaaaatgaaggtacatttctttccattgtgccagggctacactcaacaaattgtagttaggaactataatttggcaaacttgccagtgaaaatctcttttacacagagaaagaccaggatcattatatctacctagtaaacaactggagccctcttggattatttataggtttgatcttatttctaagcacaattaggtctcttggtaactagctcacactcacattaagctttttcttcttcatttctacatgattcattctcgctattgccatttttttcataaaaccataggagaaaatcactcatctaattacttaatgagctgatcatcttctgtctctaatgctacccagacactagtgtagtggtataaaccatgttaatattgttcagtttaataataaggtcacagagctctttgaccatttgctacatataatccaacagctttcactgcactaaggcattgatcctattctgtttcctgtaatgaacttctatgtgcccattttggatcaggcaatttatttcattctgattattcaaacaaaatgagtgcatggccttacacgctgaagggtaattcactgagcaatagaacaccttcttcttgtgaaacctgaataataaggaaatttcattcctcttcaaaaatgaagatgagcaattacactcagaattccatttgatctgcttcagagctgcatcagtagccttccatttacacatccatgtatgcataacacagatatccatgtcctcttagctcagccagtgttatctattcccttttagtccatgaacctttattatttttctctttaaaacatagcttgaaactcaatttacgtgaaaacattctagaattaactttacttattcaacttactaatctttttaatttaaacttatgggaagtttcaaagatacacaaaagtagagggactaatataatgagtactagcaatgtagtcatcatttactcagcttcagcagtttttaacatgttgctattcttggtcgtctgtccacacacttaaaaagaattttgctggagtattttaaagcaacttccaagtaagatatatatcatccataaatacttgagcatttttaacataacaatagcattataattagcaattctttcaaactatctaatacttttatctaataatttttctccattgtctcaaaaatgtttatgcatagtttgttcaaactgaggttccaaaaggtctccacgttgcatttggttcgtgtatttcttaggtcacttttaatctgacaacagttatagctccctttttcatagcatgtatttgttgaagaaacttctcttatttatctttacagcattttcccaatattgatgggctaagcttgtttaagttgattcatatgtaacccacaaatcagtcatattgattcttcccgtgctttcagtctgccaggagcagcctgtcctatatcacttaaataaaaattgctgtgctttatataaatacaataaataaatgaagtaaatggatataattaacagagttaaatatggaattttactttaaaataatcatcttgatttttgcggatctcactgagaagctttcatggtgaattatctgtagggtaacatgactttttcccatcttgctaacaatgcttcagctcaaaggagaacttgtgtcatcattagatatgacatatacatgcttcacctgtaaatacagatacaaattttctgggtatatgtagttttctggtgtgctaagaaactgtgctcttagtatgatccatcttttctactattcaaatcaccctgttttcagtgtttcagaaatgatttttaagatccataaagttgagagaccagatggtttcctttccaaacatttatattttcctcgccctagtatcaggaagttcatttcagattgtatttctgtgtttgaattgtgtttcctctaagtcagaatacaaacaagttgagatgtaggataaattttcagtatattgtacagattgtgctgttgctgcttgtttggataacattgtatgagtaatttattccaaaagtacactgtctaaaacctcagataagaggtgtaaagtgcagagtgagaatagctatgggaattttacacaatttttttttcttttcaactagctagagtacttaagattttatgtagtgcaggtatatggggaaaagggattccagtttatgtgaatagtatagatctgcacaaaataaattgtttctggaattgtattggtagtagtgttattttattttgtttttctttttggtgtcacataacaggataatggttggagcaattctgaaacaaaatttgtaagaaagacccttaagagagaacctaagtcagtttcatctaatttctcaaaagatttatattgaagtctgtttcaaagagctaaatggaatgagtaggtaaaagtagtctcatttcaaataacccaaatttagtttggtaatttttaattttcttttagttacaaacagtgaaaccctcttcacagcttacgattctcatatgatcagatgtcttattttccaaatatatcattcttgaggctcttgcatgtcctgattagtaaaaagtttaatatctttctctttatcaatttttttagcatccttggggcaactttgtccatgaaccatcggcacttactaagtttagagtgtctgaaagggtcaatcctgcttccaaatggcaggtgtagaaagaacttcaaaatcatagcagctcgtttatagcctgcatctcgaggatttctcctacactgtgttacagatgatgttcttctaaactatatggatgttcttttttatctattccctgtacaaatttctatcatgcccttcctttgaactccaagcttagagctctttcagttcatacaatgttcagccattgtttcccaaagcttggcatggtaccaggctgattaggtaccaaaggattttctgtcttagccatatgtgtttgccagaacccttcctgtaccttgaatactcaagctggtgggtctcaaacttgaatctgcgtaaggatcacctgagcatcttgaaaaaaatgcatattcctgaccccatagcaggtatctcattatctggattggtccagattatggaactctttttgggtccagggatcttcatgtttaatagcattctaggtgtttctgatgcaggtgaaaatatattacctactagagcagtagttctcatatagcttggataattaaatcatcagaaagcttaaaaagtatcctaaatcccaggaccccaacctcaaccagggaaatcagagcattagagtttagtaagggcataggtattttccaaaggttatccaggggattataatctgcagccagacatgagaaccaccatcttagactgctatgattaaacagagtaccagatgtgtcctccctcaagggggtagattctctttgagacacttaatgttttttatttgtttctgtcatctaaccttcatcaaggccaacactgttcaccctaccaggattttcatatttttaaaaatttaggggcccctgttcttttcttacaaactggcccttccaaagtcaagtcatgtgtactaaatgaaaagcacatctaaagctaagaaatagggaagtgcatccacaattgaacaatttagaagggccttttatgttaggcctgaagcagttgcattaagttgtgttcaactacacagagaaaatcttgccttgctaaaattgctagttatgtccatttacacactctattacaaagccctgcactcctaggcaataggttttagtacacagatccagacggtgttgtctaacctgaggccctctatgccctcactgtaatttaaggtcaaaaacgtcaggctccttcacctcgatttcatggtgatggaatcctgaacagggcagagatcagcggcagtttcagcctagaccataaacctgaaaaagccaagtaaatcaatctgaatgaggccatttaagataattcagtgaagccaactttaggaccaaggtttaatgtttcatctgcttcctcaataagtgagttgtttttaaaaccaatggaaaggaaatggcatagggagaaagtgggctttaaacatgcttgctctttttctttaagacttgttaccataaaacactcatatgtatatgttcaataggtaaaaatattatttctcattttaagtcagcagaacaatatcataggcgaaataatttttatgaatttaaactttgattttttaaatttatatgtaattttagaactacaaattttaacataataaatgaagattattgaaaatttttaagtgccaggttgatgtttgtgcatgtgaagaacttgtagaaagaggagatggaggactttgacattgcttatccattaatgattccaacccttcctaataaacttgaaatgtaatacagtgaacatacttcccatgccaatgcagtttcaagataagttctataagcacaccttcctgaccccaaactccaacctaccaaccagctttctgccactaaaacacttctataaaggaattctagggtgtccaatgatataaaacaatattagatatacctagtatcttccagtccctctccaaacaccctatgctcaacataagctattatcagaacccacgtatggtttgtcttacattcttacaaatttatttctaaatataccctacatgtgacatgaattgaaaccctgaatacatataattaaaactggtaaatgctaagtatgcatatgtgtccacttttctgtgccacaaaaatcactcagggttgtgtgttatttttaaaaataaccaatttaatggctactgggattattagaaacactcctataagatttctactgtaagtaaggaactacaagaggctttctctgactgcttaaccaaatgttaggttagcttctaaattatagagtaattagacgtttgaatttgttataacagctttatgcttttcttttagccattacttgtcgcaagcaagatggaggacaggctggaatccatgagtgcctacagtatgcaggccctgtgccagcccttacccaggcctgccagatcccctgccaggatgactgtcaattgaccagctggtccaagttttcttcatgcaatggagactgtggtgcagttaggaccagaaagcgcactcttgttggtaagaataattgggatgccaaagccagtacacgtcaaagtagaggaacataatacaagtcagactgagagaattctgacagtgtatttgaaaaataatatgccaatggatttagatgtatattttaaatttagctggcagtgataaaagcattatgtacttttagtaaaaagaaaaggaaggcttgaaaattgaactctgactccctatataatatgcagtggattattttctggtgtagacataatcttttagtggactgcctgcagactgtaaagtgcttggagcaaagtttttggggaacaagagaaaaagttgctactttgttaacccattctcactgtcagagcctcagattatcctttctcacctagaagggggaatatagcattaattctgtatctgaaaattgtattttaaaccatagtaatgactaacagcatgaatataatgagcaggattaggatccatcactctgaactaaagcttggtgcatttgaaatattgccaatggcaaaagcaacctaaaaatattggtgctagtagagtactcagaatttaagttaaaaaatgaaccacctatgtaatgaagactgtcgaaactatataacacagcctatgaaggtgagagataaatatatacttatctgtagtataattaaaaagtatgtgaaaaatagtgttctgaaaaaataatacaaattttactatgcaaagcacccaataccaacaggagcctatgtagaaaacactgtggaatgagaaaatagcattgatttataggctactgttaaatatggttaaaaatgaagaaaaagaaattaggaaagcagaaaatttagggatgtgtgaaattaatgatggtattttccaacttaaattgcctgattgtttctcttccacaggaaaaagtaaaaagaaggaaaaatgtaaaaattcccatttgtatcccctgattgagactcagtattgtccttgtgacaaatataatgcacaacctgtggggaactggtcagactgtattttaccagagggaaaagtggaagtgttgctgggaatgaaagtacaaggagacatcaaggaatgcggacaaggatatcgttaccaagcaatggcatgctacgatcaaaatggcaggcttgtggaaacatctagatgtaacagccatggtaattcaatcttcattgttacatatttgctatcttcgggagtgtggagggaaaatgcacacgcatcatagtggaatggaagtgaaggtttacagacgtatattctaaattaaactctgaagcaccacactatacatatatcatttatatgtaacaggacattcaatggcattgcctcattgtccagaagttggcaacttaagtcccaaagataatgacaggaagcctgatggggcccaaatcttgcaaagggtaggcaaaactggtgccagaacggtcccccagagcttatcaagagcctgtacattaaacacacccaataatccctaacaagtctgtgcacaggaagggagtaaggaggaaataagatttgaatcagtttgagatttaaacagacttttaacacctaaactggcaagatttgcaatatgcacaaaatgtcattaagcagcagagaagatggcaactagtaactggtgaaaactcaaacgtttattctctattgaatttagattgacacacacacacacacacacacacataaaacaaacgaacaaacaaaaagaaaaatgtgcatactcctaggaaactgtgcccacttttattttctaaaccaaaaaagaaaggaaaaacgcagcaattataattgtgttgccaaaagattgtgaatggtgccatctttgaccagaatatattcaatcttaatataggcagtattaagcaattttctctggtcttcttttattttaatacatctgtctttttataatggaatgaaagaagtttacagtggggcagcctgaaacatagataccacatacttgcaacaccagatgatgatctcttacttacttgatagaagtggccaagaaaggatgagttaaattgctagaagcatgatacatggcagttatcctccaaccttgctgaaatattaatatatcctgctattggaatggtgctgctccagttttattatatggttcagaaaacaatgctaataaaaaccatctcatatttataaactatcaaagtgtatggtgacatatttattgaaatctcttaaacatctcactacaaagaagtttcatttaatatatatatacatatatatagtttcattctatatatacatatatagtttcattatatatatacagcattttatatatatataaaatagttatatataatgatagttttatatatatagtttaattatatatatagtttaattatatatatagtttatacacacacacacacacacacacacagagcagacaactgtgccccctctctttttttttgttatactttaagttctgggatacatgtacagaaagtgcaggtttgcaacataggtatacacgtaccatggtggtttgctgcacccatcaacccgtcatctacattaggtatttctcctgatgctatccctccactgccccccatcccctgacagaccccggtgtgtgatgttcccctccctgtgcccatgtgttcttattgttcaactttcacttttgagtgagaacatgcagagtttggttttctgttcttgtgttagtttgctgggcatgacggtttccagcttcatccattttatgatgtatatgtgccacattttctttatccagtatatcattgatgagcatttgggttggttccgagtctttgctattgtgaacagtgccacagtaaacatacgtgtgcatgtgtctttatagtagaatgatttataatccttcgggtatatacccagtaatgggattgctgggtcaaatggtatttctggttctagatccttgaggaatcgccacactgtcttccacaatggttgaactaatttacactcccaccaacattgtaaaagtgttcctctttctccacatcctcgccagcatctgttgtttcctgactttttaatgatcaccattctaactggtgtgaggtggtatctcactgtggttttgatttgcatttctctaatgaccagtgatgatgagctttttttcatatgtttgttagccacataaatgtcgtcttttgagaactgcctgttcatatcctttgcccacttttggatggggttttttcttgtaaatttgtttaagttcttcacacaaagaagtttctaaaactcttgtccttttgttgttaccttatcacatagattctattgtattgaagtctagtgatatgcaaagaaatgataaatgtttgaggtgatgggtcatctcagttatcctgatttgatcattacaggagtatgtatgtactctgtaatatcacaggtaccccataaatatgtataatattaccattttaactatctttaagtgtgttcagtagtgttaagtacattcacgttgttgggcaatcaatctccagatcctttttattaaaaaataaattttattgtgtatatttaaggtaaaaacaaaaaaaaagtctaatgatgtgaactccaaagactccataatattgaagctctgcatataagtatgtttcaggttaatatacatgcattgctgagttgaagattattacatgccttgagaacaataactataaaagtaaagggaacttaatatttataatccatgtactttgagaaacatctcaaagagtaattgaatattttattctctatatgaaataacataagtgttataaattagataccaagaaaaatataaattctctttctactttgaggtgataatgtagaaaaccataattagccattaaaatataaaattgaagatcacttaaaagatgtgtttattttggaatgcagcacataagtgtttgctcacattttagcttgttatgcatactgaatcactaaaataattgtttaacattacctgtgagcttccagaataacatttatattttctcactcttgccttgatttgttaattagatgcatgagagcatcagcaagccacttcagtcaatcttatatttagaaacatcttttaaaatattctgtgactcacagaaatgtttgatcacttcaaaaaagtaaaagaacaaaaataattgaaattggccaaaggcagtatacattttttattttagtattgtcaactcacagcatgaagaatgcagtactgtattctagagaaaggcacttacagaaaaatgatgaatccatgatgacattgacttcgtggggattccgaaaggatctcagaaagatccttaatgaagtgaatggttctagtttagttcttctgcatgtcctgcatcattcctttctcaatctggtatctgacggaatgtccaattgatattttagtgtttactaacataattactcaaagtaaagtcttgagaaattgagtctccaatgcctgatttctttgggaattcctgctttccttaaatatgttctgcaaattctggtgtttgtggaatgttatgactttgccactctatcccagtcatcccctaattataatctctatgacaacttctttctttcagccaaatcagctttctagatggatggttattaagtggctctggagaaaaaagtatcttccagctttcaatttaaagacaaaattgatccccgtgtgtgcagtgcaatgacaataatcccctattcaatagtgtccttggggtatttctgtttaatcattgttgtctatctgtggatcatattaccagttattatattcataaaccagtttgacttttaccagcttaattatattattttagactgtttcccactaggtcacttttttttaagtttcttaaacttgaggcagaattctgttatttttgaacttgtgtgtaataataggctctgtgctgaaaagtgatataactgcattgccaaaatcagatattatagtattctttgggagccacataaaagttcatccatcctgatgcatggtattaaatatagtcactgcacaaatgatatataaacacacttatggcatatctgcagtaaaaacataatacaaattttgtatatttactcttggtatgaaatattggaaggtgtcactatagcaacaattttttagcagttttttatgcttttttttaaaattatactttaagttctgggaaacatgtgcagaacctgcaggtttgttacataggtatacatacgccatggtggtttgctgcacccatcaacctattgtctacattaggtatttctcctaatgctatccctcccctagcccccgacccctgccgacaggccccagtgtgtgatgttcccctcccttctgtccatgtgttctcattgttcaactcccacttatgagtgagtacatgcagtgtttggctttctgtttctgtgttagtttgctgaggatgatgctttcatcaaccaatatcatcttagaggaatcttgtgatgaataaaaaatgtgtaatatgatttttgagtgatttaaaattgttgctatcctctcaaggaaataagagagggtagcaacaacttgatgattaatttattagaaatgtattgagagcctaaccacacagtactaggtacttctcaagttaatcatcttcaaaatgttacaaaacaaagggcagaatatctggaacttttttattatatcatttaatcttcatattttaaacaatcttagaggtagcccagcttatgcaaggtacatgtatacaagatttctatttaaatggaaaggatagaatggtattgtgccacccctcagcttgatccagtgctcccaaatccctttatccggctttacattttacatttctaaagggtgtatcatcttataacataccatataatttacttacttattatgtttcttgtttattctttatctcccattcaagaatagagattgatgaggatatcttagactattttattcactgatgtatcctaagtacctagaacagtagtaggtgttccacaaaatttgtagaataaatggatgaataaaaagctggagagaatgatttttttccagataaagagttacaacctactggcgttgcagtggtttctatactttggggtgactgtggcaatttcttaaaataagacagtaatgaattttgctgcatccattgactttttcattcactaaagagttctctgttgcatgcaatgttgtttgatagcattttacccactgtggaacttctttcaaaactggagtatatcctctcaaaccctactactgctttgtcaactacatttatgtaatattctaaattctttgttgtcatttcaacaattgtcactgcatcttcacccggagcagattccatcttaagaaacactttctttgctcacccatgagaagcaattcctcatctcttcaagtgttatcatgagattgcagcaatccagtcacatcttcagactcctcttctaattctagttctcttgctgtttctaccacatctgcaattactttctccactgaagtcttgaaccccctcaaagtcatccatgagaaccaacttcattcaaactcctgttaaggtagatattatgacctccttccatgaatcatgaatgttcttaatggcatctaggttggtgaatcctttccagaggttttcaatatactttgcctggatccattggaggaataactatggcaagtatagtcttacaaaatgcatttcttaaataataagacttgtaagtcagaattactctttggcccatgtgctgcagaatagatattgtgttagcaggcaggcaaacaacattcatctccttgtacatctccatcagagctcttagatgactacatgcgttgtcaataagaactaatattttgaaataaatctttttttctgagcagtaggtctcagcagtgggcttaaaatattcagtaaaccatgctataaacagatgcagtatcatccaggctttgttgtttcattattgagcacaagcagagtagatttagcttgattcttaagggctctagtattttcagaatggtaaatgggcattggcttcaacttaaagtcaccaactgcattaacccctaacaaaagagtcaatctgtcccttgaaattttgaagccagccattgacttttcctctctagctatgaaagtcccagatgttgttttcttccaacagaaggctgtttcatctacattgaaaaatctgttgcttaatgtagtcatcttaatctattaccttaactagatatttgagataacttgctgcagcttctatatcagcacttgctgctttactttgcacttttatgttatagacagcttctttccttaaatccaaaccaacctctgctagcttgcaacgttttttatgtagcttcctcaccttgctcagcctgcatagagctgaagataggatcttgctcaattaggctttggtttaagggaatgttctgactggtttggtattctttctagaccgctaaaactttgtgcacatcagcaataacactctagtactttcttattatttgtgtgttcacaggagtactactttcaatttccttcaagaagtttttctttgcattcacaacttggcacccccaaacaattacaatagtaacagcaaagatcactgattacagatcataacagatataataataatgaaaaagtttgaaatattgcaagaattaccaaaatgtgacacggagacacaaagtgaacacatgctgttggaaaaaatggcaccgatagatttgctcaatgcaagattgtcataaaccttcaatttgtaaaaaatgcacgatctgcaaagcaaaataaagcaaagcccaataaaataaggtatacctgtaaaacattctaatatacttacattgtttctttatcaagttttattactctgtgtaatgcattgggtattaagtcttaatggaaaattggtgctgaacactattaaaaaatcaaagcccaattcagatttgtcctttgaaaatagtcatatttttgctgaaggaattccatattaattgaactttaatgaaaaaaatgattccacattttacagctcaatagtttttattattttactctaagactttttgtgcttgaagaaaaaaattattaaaattgcaaagagaacataaatgaatatatcagccaaaatattaaaatatatctgtcaaagtattgaggaagaaaaaagtctttttcagttcatctagagaaataagagggttctaggtttatttactaccggattgtcaaacaaaatacaatattatgtttaagtgccgggcacacttttctttgtgctctaagaatcatgatccaatggctctaaaattaccaggccttggtactgccatgtggacatcatactggcattcagaaagctaacatacagtttttgtaggccactttaattatgttcatttgtcttccaattgtagtaacaattaaatagttcagaatagtttgtctaatgccttattaatataatatctctttaacattaatttttaaatatagtgatttgtattgacttttccatgttttctctctttgcctagtatgcttgtgaatgatattacagaggactttctggacattaatgagtagcttaagcaattgcttttttgcaagcatctgtaggattcaaagtgtgctttgctagcacccaaagtttctctttaaaaatttgctttcataccagtttgcactatagcactaattattaaaataaaaagaaggctctacaaatattacaaatgaggaaaaaccttttaatagaatatctttacattataaatatgtgtgtggagtatttatatccttgtgtggaaacatttaacattattgcctaatagcctaagcagtctactgcttattccaccagcctctcacagttctgacacagatgattccaaagcaggtgtcatgtttcaatgaccattactagctactgcaaagaagtaactgtaaatatgaaacactgttttgtatcactcagggctccagtacacatgtctcagctgtgggattcttttctactaacatttgtaggaacaggaaagaatcatcaaaaaaaaaacctggaaaaggaatacatcgtggatgaactttaaaaattataatacccaatttacaaatagactttaagagtttgtgcttttaagttgtaatatggaactcaagataaaactgataaatataatcatgaatatgggtagagaataacccacctgaccactcaaccataaagtaactgaaatgtattactttttgtaataggattctaccaaagattatataggttcattattagaggttaattagaaacaaaattgaatgagaaattgttccttatcatagtggatactcgtatttgaggaagaacatgtttaattaaaccaggcagaaaaagcaataaatagagtcttgtaaacaagctgaaatggagtcctaatttctccaaagagcttttccatttggtagaatttatttaatgtctaatgcatttcagattttcagtgtctcatttgatagcataggtagagcgagtattgcttttgcagttatcattcacaactggaatctttttttcctttcaaatgtaaaagagaggcaggggatgagggacagacttttcctgaggtaactagttgcaagtttaaagagccaaggaaagaaggaaagagcatctaaggatacttgggcacaaagagaaagcaattgcctagggtcgaatttaaataaggtgtggagatcagcactaagctcacacaggctccctgagggagcacagaggaggtgatgagggagagaagggctggagattttcctgcagctgccattcatgtctggtgtgatggaagagcatctgccattgtcatttagttcatgttccgacacctcaactcatctactacttcatatcatggttttcaaactgggtttcccagagcccctcaggccaggctgtcaaacatagcctccaatagatcctgtgtccttatttggctttccttcagttttttaggaataaagtgttctattgcttaaaataaatttaactgccaagaacaattcattatttgcaacaaccaaaaaagaaaaattagaattttgcctttatcagcaatttctgccactataggaaattttaggtcatctggatataaaacaaaattgactctcctttgatcttttaaatagacattttataaaacaggaaatttatccaaataacactttcccctccctttgttgaaattaatttattgctagtttatccatgtttgacttttgacctgtaaaatataaaataatgtaggaagaagaaactatcttaagcttttggcatttttgtttggttgcttggttttgcattttcttctatatctggaaatggaaattaaaaaaaaaaaacctactttaaaaaatcttaaattccgaatgtttcaaaacatgaattcaattttaaagcattccaattataatctatttagatctatttctctagtccagtgaaatgctatgtgaaaaagtcagtcagtaattatgggaatgcagtatctgagtcattctctcagagagtcatagtttgtattacccaaaagggaaaagtccagggtaaatagacctgtataacctagtttcatgcagcagtttttcaatttaccacagactgctttttgttaaaattatgtttaatacttattagaatccagtaaactagtgtttaaagatcatcctttgcaaatactttcatggcaatattagattttaattgattgaaagaacagtgcattgcactggatcaagttaaaaataaatcattttaataagcttcaaaattaatacatcttccattacttcatcttcacaatttgaacactccatcaaatatgtttgtattcctgacaaagccctattactaatgtgaggtttttaaactctgcatctgattttcaacatcatgttagttaaaattataaatgttaaatatgaggagaaagtcaataaatgccttagtatgtgtaatgattcccaaggtttgttattatggttgaataagtaaaatataaacacaggttcttacatatataagtttattttcttttttaacaaaatatatatttgaaagtgcaatataattctgacactaactacctggagttaggccaaacttcacaggttaagggcccagtactccacaagactcctctcacttcagatatcagctgcaaatttgggagtctccaagccaaccttacttctcacaagctggctgcaaatttctgacttcccagtactgccccaggctcagtaattcactagaacagctgacagaacttggaaaagcaatatatttaccactgcagttttataatagcaaaaggatacaaatcagaaccagctcgaaaggacaggtagctgaggtgagggggcatctgaaacatgaggcatccataatctctttagtggaggcaggaggcatctttctcttagcacactgatgtgcatttccaaacagaaagctcacctgagctttggtatccagagtttttattcaggtttcattatataggcatgactgaagaatcattggccatgtggttaaatgcaatctctctcgtcttaaaggtggtcagataacatgtagctcaaagctccaactctctaatcagatgattggtctctccggtgtgaccagccccttcctgagatatccttacagcataaaatcataagtagtctgaggagcccaccatgaataacatagatagttctatcactagtgaaatttcagggccgagagacctacctggccaagggccaggcaaattctttattatacaagagaagcctttagagtttgctgtaagaaacgcccttggtaatgaacttgtacatagatatcactcaatgaatctgaaaaagcgtggtcattgagtaaattcccagtattaaaataacaataacaaaacctcacagccattcatactgatattgaaattttctgtgaaaatttataaatacttagcagatatgaatacatatgctttcaaatgtatataaaatgaataaatataattaaaataatattgtattatacttctataaatttgcctgggtactttactatgataattaattgcctaatattgatttataacttttcatccatcaaatatacaacgggtagaacattggaatataggagtttggatatatatacatagtaatttggttgccccaggtatcagatcaccagtttttaatatataattgctcaagaatattgtccgtttggaaagtttttgcaaaatgattttttttttcaactttttccagcctgtgaggaccacaatagataaaagtctagctacattttctcattcccagttgcaatcaagtgaatataatacacaattaagtagaagagattttttgaggttgcttttgaaattaatccagatgtttcagagagaatgccagagttactcattcacacagctataaatcagaagcaaccagtattttctatgtgctttcaaaatgaattctttgatccatcaacagtattcctttcagcagcacaatttagtaattgtgaaagttgttgaaatctactttatctccacattcataattcaaatgaatgagtgattgtgtgtatctcaaaggcaatatgtcctccagttgccactttaagcctgctagtcttttgtatttatttcaacctgaaagcagcagtcaaaaatataatcagaagtctggagtttaatttttccaagcgtcaaattctgtgttgaactgctgaaagttttaatatcctaattgtgaagtcatttattttatcctagcatcctcagaaaccatacattgctataagatgccagcagtttatttagccttaaaacattctaaatgtttttctttctttccatcccccatgattgtttggtgttaattgccctaaaaaatgatctgagcagagaaggcaggggaatgcttttctagcagttcactagtagcattaaggattttaatggtgctagataaacatgacaggcaattagtgaatgttgtcagacattggaaaataaaattgatatgctaggcaatatacgcttttgcagttttatctttatctcagtttctaatttgcatctatcttttaacagtttaataggctgcattttatttgagagatgttttctggaatatgctattggaaaatcggacataaaagttttgtatctccttccttaataacacaacgtgaatcagtctgaagtcatacatgttaaatcttactaaaaccataatatttcaatcaaaaacaattttccatttatctgttactctgtggggtagtgacatgtaaggccaccaggtgattctattttcagttataattactgagctaaaaaagcctagaggtttacttttgagagacattttgcagtttatcaaggtgggaaaatgcaattcttataaaaatatttcctttgaaataacttattacctttgaaatactagtgctcttttgccaaagccattgataatatttggaaatgatttggatggttcttaattcattgtagtcttacaaatattattaaatgatttggtcataatgccattgatttggaaatgactttagatacttttaaagtttgattgtatttattaaactataacttatttaaagaaaataagtgattactggccctaaaataagaagagttattttttgggcatctcatactattttaggtcaattaatttactgcctcagctgtaggaaaaaaggcatttgaagtatatttcaactcagaatcatgaaggggcttatttctccaccccaaagcataattaaagtcaaaatgtaagatttaagtagatcactgcaatctattttaaaatttcagtaacactactgtgaaatattcctttagttctttgttggactttcctctggatcattatcgatactccaaaagtcatcttgaatatatgagaagtacattagaaacttagcagtggcatcttctttctgtcttctatgtctcacaacaaacaaaatcccaactctgccacatctgccctccagaagattatctgggactaatgcccactttcagaacttttcattgtatcctaatcttcatgccaaatttgtgatcccattttttaaaatttattttatacttcatttacaatggataatataatatacataccatccaatttatccatttgtctcctaggagtacaccaaacagaaatacatacatatgtccatcaaaagacacattctagaatattcatagcagcactgttaataatggccccatattgaaaactacctaaatgcccaccaccaatagaatgaataaacaagtcatagtatattcacacaatagaatgctacacatcaaccagaataaacaatattcagcaatatgcaccaacgtagataaaacgcatatcacaatgtagagtgaaaaggctagcacaaatggatataaactatatgattcgatttacatgaaatttttaaaaagtaaaactattctacacagtgagtagtcaggatagttgttgctcttgtaagaaggggcagtggctgcaagggaatacggaggagagttctggactattgatttcaggggtgtgttcagtgaaatttacgtctatggaaaatgcacttttgcatatgaagactacaatacgaagtttaaaacaaatatctttgacaaatgtataggagatactacataaaaagatatgccagaaatctatttatcttccattttttttggttctgtctgtatcttatagtagcacttcctaacttaagacctacacaatcacacacacaaatgattaaaagtaaagcttgtgaaacctgagtaagtgctatggattgtattaatgtcaataacttgagggtggtagaagcttatgtttttaacatgtgtctcagataatttatgattaggcaaggctaggaaatactgtatagtaaattagtattttaacactttcaatacaggacagtttgggcacaatcttatagattaaatttgccattttggtttaaaggtggtctgactttcctttaattaaagaaattaatgttggtaggttctttttaaaatccacctacaataaaaagaataaaatacttaggaataaatataacaaaataagttcaagacctgtacactgaaaactacaaaacatcattgaaagaaattaaagatctatataaatggaaatgaattccatgtgtctgaattaagacggcagtgcttccaagttgatcaacaaatttgacacaattcctatcaaaatcctagctgcaattttttgcagaaattgacagtctaattctaaaatgcatatagaagtttgactcaaaatagccaaacctatctttaaaaggaaaaacgaaataggaagactcacacttctggatttcaatacttgcttcaaagttacagtagtcaagactatgtggtactatcatgaaactagacatggagataaatggaatagaatttacagttcaaaaataaatcgttacactgtggtcaactgattttcaacaagggtgccacaacaattaggaaagaacaggttttttcaacaactgaagacaggataactcaataaccacatgcaaaagaatgaagttggacccctaccttttatcataaacaaaaattcactcaaaatgaaacatacacctaaatataagagctaaaactattaaattctcttgagaaaacaactataaacctagatgaccttgactttggtagtggattcctagatataataccaaagcactaacaaccaaggaaaaaagataaactggacttcattgacatttaaaacttttgttcttcaaacaacaccaaaattttagagacaataacaagtttgacaagaattcatagaaattggaacatgcgtgcatatctggtggagtataaagtgctgcagtcattttggaaaacagtttgacacttcctgaaaaagctaagtgagttaccacataactgagcaatttcactgtaatgtatatattcaagggaattgaaaatgtatgcccacacagaagcttgtaaacaaatgttcatagcagcattattcatgatagacaaaaagtgaaaactcaaatgtccattaactgatgagtggataaacaatgtgaaatgtccatacaatgaaatattattcaatcatagaaaggactgaagaactgatacatgctataacataaatgaaccttgaaaacattatactaagtgaaagaagccaagccaggcatggtggttcacacctgtaatcccaatattttgggaggccaaggatcacttgaggccagaagttccagaccaacctgagcaacaccgtaacacctcatctctataaaatatatatatatatgaaaattcgcctggcatggtggtgggcacccttagtcccagctcagctacttaagaggctgaggtaggaggatctcttgagtgcaggaggtcaaggctgcagtgagctatgatgacaccactgcactccagcctgggtgacagagtgagacatctctaaaacaaaaaagaaataagatcacataatgttttacttcatttatatgaaatgtctagattaggcaaattcatagagatagaaagtagattcatggttgtcaggggatgaggaaggggaaagtaggaagtggctgccagtaaccatagggtttatttttggagtaaaacaaatgttctaaaattagatggtgatgatggttgcacaacgcagcaaacatactgaaaaccaaaacatggggttatttttatggaatatgaattatatctccataaatttttaaaaatctacctagagttgcctagtatcaattgtttacattataatcattgtcaaaatcgaatctctgctgttgagataaaatggcaaggcagagtgttttcttgtaccaagaacaccttctctccacattcagactattatagaggacaaccgtgcgtttcattcttgactagaggaattttgctgttttcacatgtttgccttgagaataatagtgtttaattgatattgtgaaatggcaagtttgtagttaagaagtattgaaagaaaatactcccatttcccaaaacaaatctgtgcactattaatcgaattggttggatgatttgatggaatgagtactggattagacctcagaaaacttttccctgtctcttactgtgtaaccttggactcagtcagtcatcgctctgcatttgttttcttacctgcctgttagaatgtcaatacttgcacaattcatacataagattttcaagagaatcaaatggatataagatgtgaagatgctctgaaagtgacagcatgtaaaacatgagacattacttaacatcctgcatttttcttcagacttgattttcaaagaaggagaaacgcaagatgctaagttaaatggttccttttgggtattgagtgaaagggactgggatttcttaagaaagaacgttgcatggactcagaaccctgaacttgtgtgacattaacagatagggttttatagaaaactgttataattttttaatgtatcattctgtcagcatgagaatgatatggcagcagacaggttattgtcaattaaacacgagctgtcagtcagaaatgttgaaatatggtgagcatgaatcctaagcagatcacatggcagctgctcaactgttattttaacagagtcactgtatgtatgtgacatttccctgcagaatttaattcaagtcccttacaacagagacacctctgcatttgcatgctgctgtcaagtcagtcttggaccttctaaatgacctagaatagtgggtggtaatgggagagtgacaggtggaggagatgattcttgtctcattttcctctactcaggttacattgaggaggcctgcatcatcccctgcccctcagactgcaagctcagtgagtggtccaactggtcgcgctgcagcaagtcctgtgggagtggtgtgaaggttcgttctaaatggctgcgtgaaaaaccatataatggaggaaggccttgccccaaactggaccatgtcaaccaggtattttctatcattgacagtgttaagatattgttgagattcacaatgatctgattttttctccaaaatggagaagaggaaataatagctattgaataaaaaattgacccatttttaccattagaatgcctgaataaatacatacatgttattaaaatttcaaattagacatatctgtattctctggagattccataccttgcaagtatatatgaatatgtatgtaattcaatggggagaaaaatgacacctatctttgaaataatgtcaaggtatttaatctgtcataagattgtatctaacatgtaggctgagattatctcattcttatagtttccccaaactgtcagaaaagacatctcaattaccaaatgcttaaattaaaatcaaagaaataatatgggttttggtctaaaattaggaaaaatatatactgtttatttaaatgtgtttgatataaaacaaactgagaaaaagaaatacaaagatggcctcaaaatcactgtaagtatgctatcaatttagtcattgaccattttcaattttatttggaactctgacttttgatgcattctttcttacctgctgttaatagttgtcgttctgttctattagagataaaaagaaaaagcctaatggaggaattgtgactgatttaaatggaatgtaacataatcagacaattattaccatgtttggcctataagtgaattagcaaagaataatttcatttattatgtgtgggtgttaagttgtgtatttgaatttaaatcacaatcaaatgaatcaagtccttaaatatgtagaattgtttcatacatacatagactcattttaatctctaaacacactgcttacctgtatacatactttccttcccagattaacataactttgttcataataaaagtacattgtagagaaaacagaaagaaccttggaattaagtaaattaagatgaagatcgtgaagaattaaattctataaaaagtactctaaagagtcttgattgttccccaagtgaagttgctgattttatctttatgtgcaatggagggtaaataacacactcccttgctgccatctactggtagtttagcttccatgtcacagagcattttgcatttctaagatgctaaggaaatttccaaagaaaattcagttcagcaactataattatataactgcaaaacagaaaaactgaactaaaatgtttataatacaaaagaatatttctctacaaattttgaaaccttgaattttcagtagcaaatttaaataaattatatatgactcccaatcctaataaagagaaattctacacatactcatacctatttcactttagcgtgtatgtgtacacccagtcagatatgcaattaaaatctgtgttttcctcagattttccttaagtgaatttccaaaggttcaaaacctcaggccaagttgtctttgctattcctagtgtttggcctaaaccatttgtcactttccaactctaatatattctgatgcagtttgataagggtattgtgacttggtatcggttgactgaaggcttactgagacattaacaactgaaaaatcaaagctaaaacaaataataaatttttgaacatttgagcctaaatgttctgcataaaaatagaaacttctatgaatttgtgtattaagaaatttagggaaaataaaaatgtaaagttttgtgttaatgttgaaaattgtaaatcacataggtgtttactacaattatatgttcctcagtaaaataatcagaagcattggcttgaaaacagtctctgagtttctatttttctagctgaggaaggaagtactcaaatcctcattttctacaaaacagatgaactgattaaggtaaatcaacggatagatcaatctataaatatactgatagacaacagtacattgacaagttggatcacaagttatttgcatcatatatcaatttcccatgctatgtattgtgaggtcaactccattttctaagatttctccatcctgcccatctaattttctcattggctctgctatttacaatacccatttgtgtatcttactttttaacattaataagtagttgtgtattatctcctgagacctaagaaaaatgttctaatattttaccaaaaaagtaggtttttacatgtaagtaataatacttgaaacttaccatgtgttcttctcatagcatactgacattttcacctaccttatttctctcccttttcatcattcctgttgaacaccactccaggcacaggtaagaactcttaaacctcatgctttttgatagaatccttcttttcttaaatttcctgatttctgagaatacatttctcttcttgctttgtcttttatgttttacagggagaaaatgtcatattttccattaaagaatttttttctataactgttttatttttcttttctatcatagttacctgtgttcctacatttcatatccctcattgtaatatcaaggactgaggtgaacaagagttggggagaacaagtttcacttcgctaatctcgacaggcagtgacacccattattaatggtcttgtgcttttcagagggagaaggaaaaagtgcaagtggactgaaaatgggtgggttggagattgttctgaactgatgggtattcacttcagtacaggagtttaaaataaaagccatcaaaggattaagaagaagagcatttctccttcagtttttcttttcactgcaagttgtagggtaatgttttatcctgtgctatttagttctatttttaatacagcaactaaatgtgaatataatcacttatggcaataattgcagaatttgactccaacagtgcattttttttttaatgttttttttttttattatactctaagttttagggtacatgtgcacattgtgcaggttagttacatatgtatacatgtgccatgctggtgcgctgcacccactaacgtgtcatctagcatttttttattcctctttgagacaggtccactttattcattttacttaggtttttagttcactaaaattggcacaaaagaatggctgcaaagggctatttaaatctatcttttctagaattcattacataaaaagctatagtttctctcttccctttctctctctcttgctctctgtctctgtctctcagtgtgtgtgtgtgtgtgtgtgtgtgtgtgtgtgtaaaataagggatagagttggactatcacagattagaaaaatactttcaaagaattttatttaatgcttgagtcagcttggttgcaatggattaagtgccatttatttcctttatttagtcattcttctcattgaaaaaagaacataattggttcattgtactaaaaaaaaacctgaaaccaagcataccaccccaaatgtgggactgaaaggctttatggaccctggagcagagacaatttgccttgtttcatgtggccctcactgcttgggcttgtacaccaatatcagactttgcttccaagccttaaatgattgaggattagttttaagatggctttatttcatattgtttatctttttaatttagtttcccatatgatacacaccaaaaatctaaattctcatcattatttatagttatctggaaaataggccaaattatatttatttggaaaacagctatgttttatacttatttgattcatcaatcctcatccttcattcaatcattctgcaaatccctattgagtacctaacatgtgagcaccctgggctagtattgaagtcacacaaaactgtaaatgacacagatggtccagaaagttacaatacggtgtgttaagggtcagcataggaaaatatgtaacctatctaatgtgatccagtggatcagatttacacctgcaatgtaatagcagagcaacagagtacaatatggttagccctatcctctactgctagaactcttgagttctctctattgcaatgttagaataataagcagtaaaggaggggagtgaaagtagcttcacagtgaaatgattgctgttatggtgtggaagtcttcctcctcactcttaccagattccctgagattgctgagaaccatgtgtgtttcaggtgtatgaggttgtcccatgccacagtgactgcaaccagtacctatgggtcacagagccctggagcatctgcaaggtgacctttgtgaatatgcgggagaactgtggagagggcgtgcaaacccgaaaagtgaggtaagacaaagcctaattatacagaaaagcaagacacaaaactatctcccaattgcacatgtgccaacatgactgttcactcctccccagtcttctggataaaattgtctgcagttttgcttttagggaatctgtgctcatagaaaactctaagagaatctgcttcaagcagcagtttattatattctggccttctgatttaggaagcatcacttcaaatactcttaaagagaaggaacagcatattcaatctgaactaatgcagattttcaaccccaataacttttttgcttcaaggccaaatatatttccaagttcctttctaaaataatctgttttaaactcttgctcttttgtatcaaactggctaactgaatactatcctgttgtccagggagctttctctgaagcccccagctggttcctgcgtgtcacttgttcttctgtagctacactgtcccataggatagccactagccacactaactcaatttaaattaaaaaaaattaagtttaaattaaattaaaaatgcatctccccagtcacactagccatgcttcagtgctccatagccacatgtggctggcagctatctgttggagagcgcagacatacagtattttttgtaatggcagaaagttccattggacagggttgttctattacactccatatacccctcactgtgttgaaaagacccctcttcatgtctatccccttaataaaactttataaaatttcttaaaacagagaccccacatattcataggaattccctactgcctaacactagattgatactcgttaaattttccatacagtatctatcacatgatccttaagggctctagaactctatgaaacaaatgcacgaggttttatcacctccattttgtagattagattcccaagtgctaaataatgtaccaagaatacccatctagtaaagtggcagccttggaattcaaacccaagtctcccatcactctttttaaatacactggtttcttttaacccttctcagtggcacccaggaaagacaaatataaaaacatccaaccactttgggaggccgaggcgggtggatcacgaggtcaggagattgagaccatcctggctaacacggtgaaaccccatctctactaaaaaatacaaaaaattagctgggcgtggcggcgggcacctgtagtcccagctactcgggaggctgaggcaggagaatggcgtgaacccgggaggcggagcttgcagtgagccgagatcgcgccactgcactccagcctgggggacagagcgagactccatctcaaaaaaaaaaaaaaaatccagcactcggcaacccatgttatgaagaagttcattcttacccataacccaacctttcatgcatttaagattggtgttttaatctacttcagtaggaaagcagaacaagttaatatttgttttaccgtataaaacctttgcatatggacctatatataattttatgtctaataaaaagttttatatttcttttttcaaaagcccatctgaactctcaatttgttttttctctgaggaccttaatataggtggactgggaatggggaagaggtagagaggtaataagtagatagggacacagaaaaagagattctgttttccactattctcctttcaaattattttttttcttcaaaataaaaaatattaccttaagaatttgatcaggttggttgtttcattagtaaaaaaaattataggccgggcacagtggttcatacctgtaatcccagcactttgggaggccgaggaaggcagatcacaacgtcaagaaatcaagaccatcctggccaacatggtgaaaccctgtctctactaaaaatacaaaaattagctgcacatggtggcatgcacctgtagtcccagctactcaggaggctgaggcaggagaactgcttgaacccaggaggtagaggttgcagtgagccgagacggtgctactgccctccagcctggccacatagcgagactccatctcaaaccactgggttgttttttcagctttcccttcaactatctgtgtacatgttactttttttttttttttttttgctttgtaaatagatagtcttaacatttccaaacacattctaaacaaagtaacttttcagatcaatttattttttcagtaaacaacttcaatgcaaatagagaagagaggtcagtattgattgcgatctctaatcatgtaatgatgtttctgtttgttactgattgagtagtacacttcccttaaattatcctctgctaatgaaggtcaaaatgtcctgcttgaatgcaagtgttgggtaacatttcaggatagatgggtctataaaagaggaggtttaaatttattcaattacactcttcctctttaaggatgatatggcctatcaaggagtggtggtagaagtggtttaccttggtagggaaggatatttttttcactgactttttctagaattgccagcacacagtaataataaaaaacagacagacttagttattgttgctttttaaatctatgcagaaaatacactgtcttattaccacacctgtgatgggcttctgactcaaccctttgtctacaacttggttctacaccgtgtatctctaatatagttcagttttctcaaagtataattcttgctccttagaaaggagaaaggccaagaatttggagaaaacaaaggaatttaaagtgccttcctttgggcttaagacttgatccaaatattctgtattctagggtgattataaaaatttttaatataaaataacaaaaataaagcctgtaagtataaatgccacaacagggacattttaacaattgtggcacatttaagcaatggaattcagatgtagacattaaaatatatcttagaaaaatagttaatgacaggaagatgttcataatatattgtagatttttaaaatggtacaaataggtaaagtttgcttccattttgtaaaatgaaaagatacatttaaagtaatagtccattaataaatatagtctgttatgagtggttatctctgatgaaattgtggaaatttttatttcttctgattttcttaaaatgagtatattacttgtaaaacaaaaaaataaaaggaagagagatgtattaatcttttctcatagtgctatacagaacttcctgagactaatttataaagaaaagaggtttaatttgactcacagttccacaggcagtacaggagagacatggctcgggagccttcaggaaacttacaatcatgacaaaagggtgaagcagaagcaagcatatcttcacatggcagcaggagagagaaagagcgaagggggaagtgccacacactttacaacaaccagatctcatgagaactcactcactatcatgagaacagcaaggggaaaatctgccctatgatccaatcacctcctaccaggtccctcccccaacatgagatttgggtggggacatagagccaaaccatatcattccaccctggcacttcccaaatctcatgtatttctcatatttcaaaatacaaccataccttcccaacagtctcccaaagccttaactcattctagcattaactctaaagttcaaatccaaaatctcatttgagacaaggcaagtcccctctgcctgtgaacctgtaaaatctaaagcaagttagttacttccaagatacaattctcccattccaaatgggagatattcgccaaaacaaagtggctacaggccccatgcaagtccaaaacccagcagttcagtcattaaattttaaagcttcaaaataatctcctttgactctgtgtctcacatccaggacacaatgacacaggggtgggttcccaaggccttgggcagctcgacccctgtggctctgcagggtacagcccccaaggctgctttcatgagctggcattgagtgtctatagcttttccaggtgcacagtgcaagctgtcagtggatctgtcattctggggtctggagaactgtggccctacttccacagctccactagacagtgccccagtggggactctgtgtgggggggcccaaccccacatttctgcttcacactgccctagtactgaaagctccacccctgcaacagacttctgccaggacatccaggcatttccatacatcctctgaaatccgggtggaggctcccaagcctgaactcttaccttttgtgcacccacaggcccaacaccatgtggaagccacaagggtttgggacttgcaccctctaatgcaatagcctgagctgtaccttggccccttttaaccatggctggagctggagagactgggttgcaaggtgccatgtcctgaggctgcacagagcagtggagccatgagcctggcccacaaaaccaaatttccctcctaggcctctgggcttgtgatgggagtggctgtcatgaagttgtctgaaatgtcttggaggcattttccccatgtcttggctactaacatttggctcctctttacttatgcaaattcctgcatctggcttgaattccttcccagaaaatgggtttttcttttctaccacgtggtggggctgcaaattttctaaacttttatgctcttcttactttttaaatataagttccagtttggggtcatttacttgtttatccaaataagctaggcttttagaagcaggcaggccacatcttgaatgttttgctgcttagaaatttcttccaccaaataccctaagtcatctctctcaagttcaaagttccacaaatctctagagcaggggcacaatgccacccatctctttgctaaagtatagcaaaagtgggctttactccacttcccaataagctcatcatctccatctgagaacacctcagcctggatttcaccatccatatttctatcagcatttttgtcacaactattcaacaagtctttaggaagttccaaacgttccgtcatcttcctgtcttcttctgatccctccaaactgttccaacctctgcccattacccagttccttagctgcttccactttttcaggtaactttatagcaatgctacacttcttttgtaccaattttctgtattagtctgttttcacactgctataaagaactacctgagatggggtaatttataaagaaagaggtttaatcagctcatggttctgtggattgtataggcttctctttctggggaggcatgaggagacttacaatcatggcataagggtgaagaggaagcaagcacattttcacatggtggcaagagagagaaaaagcaaagggggaagtgccgcacacttttaaaccattgtatctcatgagaactcactatcatgaacagcaaggggaacatctgcccccatgatccagtgacctcccaccaggcccctcctgcaacactgagaattccaattcagcatgagatttgggtggggacacacagccaaatcatatcaagagaaatctttgaaaataaagatttatggacataactgcttaatagagtgttggatatctgttcttaactctggtcaataggtaattctacaagttaatccttgcatatagtgacaccacctactcaaatgtaatatattcttaggagcaaatgcaacttttgagcactgaaatgtcctgtctgcaacatgtctctaagctgctgtcaccataacatttttttaatgatattgaaggtagaaatttttcctgggaaactcagattctcccaaaaatattcacaatttgatttatttttttcaacaaggaaatcatatcaatatctactttgcatatttttgtgattgctttttatgtatgtatccagtatacaaaaaaaaaatgcacaggtaggtatttgtttgggtatttttttcaggctacaggctcattaagacatgaccaacaacacagttttccagtgtttgaatgtatcccacagggaaaggacattcctaagttcagcagcactgcatagcaaggtgactctgcagaggagatttgtgaatgtccctgctgattgtaaatccctgataaaagttgggattccaggtatcactggcaatataattcaagtgatattttaaaacatgacactaggtttgagagacttgagagttcaagccttccttttcaactcctgaaatgcagttctgttcctaaatccattaagttggctgaccttttccaagttacacatgagagataaaggttttctctcctgctataatacttaagtgcccagagagattatttactatggtaaaagtgaagtctgatagtagccatgttaattagactcccaaaagatgaataaggagcccttcatgactgcttacaggagaataaaatggaacacaaactaacaattttttcaagtcaagtagtaggaaaatccaaataaccatatttagagaacctatgcgataccaattataattgtcttttcacttctcactttcttttaagattcacagcagaagggaggctaaaattacttttaaaatgacaaaatgaatcgataaatgcctctagttgttttcaaaaacactcaatgaaatctcccacttagagatttcagtgtgcctggtctctcatcacatataaatcaactaactctaccttctctatgaaatccatcattttcttgagaagaataaatgcattatatgccaaattgtaagccctctacgaagctctttggacagttcctcattagtttctccctcatatgtgtataaatgaccctcttctttcagaggaagcttgcataacatgcagagtttacatatacacagtggctcttatagtcaaagactcatgaatgcaaacacatttttgaatcatgcagaagcactacagatatttaggagaggcaaagatccttttaagtcttcatttgtggagaattttattagataacaaagcttcctactccccacccccataacgatgtcttaaggagaaccatctgtcctgtgggttggtcattctaattgtcctgttttctttacttctagaatgtatgtatattttctagaatatgtttatgttcttttctagatgcatgcagaatacagcagatggcccttctgaacatgtagaggattacctctgtgacccagaagagatgcccctgggctctagagtgtgcaaattaccatgccctgaggactgtgtgatatctgaatggggtccatggacccaatgtgttttggtgagatgattaacctttttattaatgtagagtttatttaattatttgccactgaagctttaaagacattattttttgaatataataacttcaatgtaaaatctgtttgtttgccatatttagcaaagcaaggtgtgtcttctctgccacatcattctatgactgtgctatttaaagtctgtaatgtttcctctcacactagaacagctccacctcttgcaagctttactaacccatcatcctaatccagcacaaaaggccttcagtttgccttataaatacacagcatgttaaaaactgcagtggtgataatgattccctccaggtaaaagggaaaatgaatgaagtaaaggtactttaatggtgtcaggttattctcatccattgctttttgcccagtaccttttatttaaatggtaggaataatctctcacacagtgggaatacagcagcaggggtattaacattaaaaagcaaaagatactgggtaagaaactaagtagaagaagaaagctgtgcaccaatgaatctctctttacacactgactctgtgtctctttgggcctggaaagccagctgagagtttcaaatcacacaaagcttctatatttcaacagccagtaggggctcatccacgagactctgggaagagagtcatttgaaacagaactggctgcttatgtaagacatttggcttacccatgggcacctttgtaaaactgtgcatttcaaaaacagcatcaaaagcatgagaaaaataactaatatggaattattttgttgaaatacaatataaaaccatttcaaagaggattttatggtgcatattttccaaggagaaattgatattccatttcagtgttaaacatactgattagcagacaactgatacagcaggaataaaacaaagatggcagttgattggaatgcaagttacactgtaataaagaatcagctgtttcacaaggatatacaattgattttctgttctaatttcaaaggatcagatttgaagttacatcaaataattgggctatatgctacactgtctgtgtttataacagtgagattttttgtcagatatcatattatgaagagattccatttttataaaaataggaaatattgaacccaggccccttcttaaacttattaatagggattttaataaaaggaaccactaaactggaactttgtccagtaggtttctatattaaatgatcaaggataatcatcttagaagaattattgaggctctattatttataaaagagagttggtgaagcatcttttgtgtttctgagagtttgccaataggaatgtttggataggaataaaattcaatgaggtgaataaactgtgcttcctgggctttatatttctttaaagaaaaacctcagaaaaattaaatttaacagtttaattgatcaaagaaccattcaagaatcgggcagcctcgcaaaccagaacaggttcagagagactccagcactgccacgtggttggaaaagatttttgggcaggagaagataagtgtcatacagaaaatgatgtacagaagtgaggttcagaaacagctagattggttacaccttgacttttgtgacaaacaaaatgagtaactaaggcaaaagtcccaatcaatcgaagtttaataagccagctttaggacacatctgggaaaaagcaaggaggttttctgaagaggtgttcaggaggttttatgtttatactttcccttaaatgggggaaggcacttaggaagagagacaggcattaaggcaaatagttatattcctgtgagactttagttagtaccccgtaatctacattttacataaggtaaggtgaatgttcgaagagaaaaaggtaatagaggaaaaatcaattatgcaggcatctctcggtaggtggaagaatgactgatctcctcttgtttttgttctgaacctgggaaaataagcttgtgattgatagcatcagtgtggaatcagactttagttttgggagttagacttaggctgtagacctaaagttacaattggtataattggtatgtccttgtttgtgggaggccatgaaagaatttacctatgaatcttctatgggagcaagttattcatgatgcccgaggccgtttatctttccttgggaatctggcacaatgctagcaatagctattcatttggaagagaatgttgcaagacggcctccaagcttacgcttcccttttgcatagggagtatgagatcctgagatttttttaaaaactttcctttacatttgtcatatttgaacatgatttgaacaattggccacatttgaaactcagtgattgcacaagagtaggttacagtctttttacacatccaaagagggtatagttcactgtgtgtgaagaaacctttaggatgaacttgaatgtaaggaggcagcgttagcctaaatttaatttgacatgttttacctttaactcacattgtttcttcactcaggccttcattaaacagataccaactaagcttttactgtctatcagtaacggtgttaggtagggagaatatacagctatctaaaacataagtcctctcctagtgcactgcagaaacgaacaagacctttatataatacacattatgtcaaaacagatagtgttattccagtgtgaccaaagtgcaacggaagcaggggaggaggaagcaattattttaggccttaaaaagtccatggaggcttgttcctggtttcttactgttcttagaaaccaactgttttcagaagactgtaccagtagatgaatggcaagccagtctttttagatgttgtcaactgaagaatgacaaggttcataaatttagaaaggagagctttacatctcataaagggttgcagcctgcagggtggccatcctgacaggctgggaatcatagctgccagccagaagccagaaatagacacttctagggaatggaaagggaacagtaactaatttgtgttgagcagggtggccaaatatacatatttaataagctatatgaggagtcatgaatatttataaaaaacaaagagtatgcatgtgcaattgagctttatgccccctcgtgtcccacgtaccaaaaatggtggcattagcatgatccaagggtgggattttcagtgctctaatgtcaaaaggtgaaacagaggtcacagaaacccttactgtacatcctccatggactacccagaaccactccttggtcagtggtttcttattaggaagaaatgctggttggttgttttgttgcaaccataaaagggagaggcagtgtcaggctgtaaccacccatggggttcttcctgcctgctgcacaaataaagaccagggtattgcagtaaagaaagagtttaatagacataaggccagccatgccacatggaagatggagttagtactcaaatcaatattgtctaaggctcctaggtaggggtttttcaaaggcagtttgggggaaggggtgggactgccagggaatgggtgcttgctgctgattggttggggcagagatgaaatcacaggggtcaaagctgtcctcctgcaggctgaattcttctgaggggcgcacaggaactgggttggcaggtccaggtagagccctgggtgttagacatgcaaaaaaatggaaaagatatctcaaaggccaatctactatagtggtgtcatctgcaggagtagctagcaatcatttatgtctacaccttagcagaattcaggttcctctcctctcccagcctgatggcctttcattagctttacaaaggcacttgggtttggggaaaagcctgttatttaaactataaagtaaatgtttcttgaagttagctcaccccgaaaacccaggaataactaagagaaaagcgagatgaaggtgggttagatcagatctcttttactgccataattttcttactgttataatttttgcaaaggcagtttcaagacaattggttgatcaggtgcagagtgagtttttccaaagggcttgtttctgtataacccttacggaagaacgcctaaaggccgagaactcagttttcaaggtttctctgtggtccctatggccaagagggggtccatttggtcagttgcaggtcttagaactttatttttttttctcaattctaaattaagaattaaaattaggatttagaattagaattgtttatatgcatgtatatgtgtgcatcaggaaaaggaaagtcactaacacctagtcatttaaagttattcttaaaatgtcttttaaggcccaaaagactatacgtaatccacaaacatataattatatatataataatacacatataactttatatatataatagcataataattaatatgaccaccatatgtgtggctgtgtataggtgtgaggtgatgtgtgtattaacatttgacacatggcatcttatagctagatggtacatcaaaatctcattcaacaccttcattttatacattgaacaactgaggcataatgaggttgactgacttttctgagttagccagtggcccaaatgttctaactcctgctccagtgctgtctctaatataccagttgtgtagctgagtattcacctttctgagaatttgtactgttctttttaagccttgcaatcaaagcagtttccggcaaaggtcagctgatcccatcagacaaccagctgatgaaggaagatcttgccctaatgctgttgagaaagaaccctgtaacctgaacaaaaactgctaccactatgattataatgtaacaggtacatggatcatcatctgatcacggagttaagtccaaatcctgtgtctgtcagctctgaagcattcctgtcagtatagttcatctctacctgtgtgccttttggatatgctgcttactttcccagaaataattacatattaaatgacagaaatacttatctgggttttttttttagtaaacactaagatagaggaaataaaaatgtcaacagacattagcccttaaagtaggttgtgaatatactaagtgttcctacataagacaacctctcacttcgggaaggtgaatctaaaatatttttggcacaggtatcagatttattcaaaaatgtctttctttttcagaagatgcttaattgctaaaacatactggggcaacaattcatgaggtgtgggcagtttataaacatgattagtcagcaatcttaaacttgccaaagattataaatcaatgctataaaaggtgcaggtaaaaattgatgagtattttcagaaaaacagatttattataagttgcatttttcccctaaaactcatttaataccatcaaggtgcatactctaggaaagaaaatcttttattggtttatatgaattggggcaacacgaaagcttactttggaatttttcccaagtaattttcactctgcaacaaactcaagaaactgtacaatgacacataacagtcatattggctttgtttcttttggtttttctcttcagtttcctttgatgatacaaaaaaaaaaaatcacagttatctgggatgtgctatgttacccagggaaagaggtgtcttttatgtcttcttacgaaagacataagagaatgaataaatatggccaaagtgatttttatcactttaataaacgtatgcattttcttgcattctaaatatggataagaaataaaatgtatgttttatctgaatataactacacagttaaagtaccgtctgtcacaattatgattatttggctaaaagtaatgctaagattttaaattatatttttattgggaaagaaagtttttaagtgacattgatctgtaagccaaagccattttcacagtgtcaccaaacggctagctatcaagattttcaagtagacatctgcctttaagaataatccctgtagctatgtgcaaccccagcaattccatttgactcctgatacgttcaaagctgggacccatatgctctgcatgggggatgattgattatggggcttaggaagcagttgtgaattaaatatgggattcaggtcatcagagtttcatttgaaatctgtttcttacttagccttctgttctgatgggcttccctttttttcagactggagtacatgtcagctgagtgagaaggcagtttgtggaaatggaataaaaacaaggatgttggattgtgttcgaagtgatggcaagtcagttgacctgaaatattgtgaagcggtaggtggatgctgtgttatatcttcgcgagtaaattcttccctaataatttcaattcatgctgagccaagtgacccgtgctccatgcagctcattgccagcagatgtttttctgcactgttcacaggctaagtatgttcttgaaaagacacaatgtccaacactactgattcctacatataatttcctgtattttcttctgcttggagcccaaaggtatgctaattagcctattctgaaagaaatgcttggggaacaatacgtaaggtgaataaaagcaataaattttaatcagactacttatcatctttgtaatgtgatgtgaattttgtgtagtgcctgggacacctgccaaggtccatcatttattctctttgttgctaaacattgatcacatgtggtttcatagcagattttgatattaggatctaatacccagctgtgaccatctaagtactcaggtctgattaagtgaaagcctgaaattcaaacagaggaatgaagtcagccattactatcttctaggtacagagaattgtaactggtattatctaattgattaaagtaatgtcacacctagatgtgagcgtctgaaatgtgaagaaacgtatttgtcctttcttagtttttatgaagctacactttatgttgtaataattttatctaatttccataccaaaaacatgacaaatgttgactctccatgcatctgaggtccactgggtcaaataccaaccaagataagtaggagcctcaatagatctggaatagagtagaagtggtttgtaacctcattagagtttagtatacacagacaccatgtgtcttctgtctacacatcctggggttattatagcccacagtaaattgttcctatacctaggggaaaactctacacagaaatattttaattcatttgatatgtttatcatgtggacctaacttaactttcttacatctccgttcatgagagcagagcacccacatgtgttgaaaacacaaatttgtttagttaataaatgcctcctgcaataaccttgtaacgttacctaatgtattcattatttaaacttgaataattagaaatttcacacttgaatcattttagtttcataaccaataacattgaagcaatataaccattatgagaataatgtcagtattgagccgagtagggtggctcaagcctctaatcccagcactttgggaggctcagtcgggcggatcacctgaggtcgggggttcaggaccagcctgaccaacatggagaaaccccatctctactaaaaatacaaaattagccgggcgtggtggcacatgcctgtaatcccagctactcaggaggctaaggcaggagaatcgcttgaacccaggaggcagaggatgccatgagtcaagatcacaccactgcactccagcctgggcaacaagagcaaaactccatctcaaaaaaaaaagaacatcagtattaatgaagataatggtcatatactggctggagagcttgctgtgatctacttctggttgattagtatgtccttttttctgcacacataaatgtactccttggtcggaatgaaatataaaataaatgagagctttgcgaaagctgaaacctaagcatacatgaccaattttaaaccatttcatatgattaaaggacaaagctggaaaccgaattcttgatttcttacatcgaatatgagtaaaaacctgggaaataactaattttaattatatgggagcctagatgactttaagcttacatgcaaatactacaatatttgaatgttgcatggcaattagggactcctagttttaacattctagcaaacactgtcttcaaggacttaaaattcgactgtgcaaccctgcattcagtgccacatcagtaggtaacactggctgcttccctaacagccacaaagaaagatggcattgttatctaacaaagaggaaaattagagttaaacctaactagcatttatgtagtattatttttatcttcagtgtttttcagacatttactcattggatacctagtaattggttttttctttcctatttcttagatttttgaatagatttctttttaatttatttacacacacatttaggtaaatgagagagcaaattaaaagagagatatgatcaatgtaaggaaaaaagtagtacaggactaaaatgtgtaagtggtggatatgtaagtcagtaataattgaatcctgtgattcaaactgtccccatgaaactattatttaccttaaatgtaacacttatttttatcatatcacctcaagattcctatctccaacctcccatgacttttaagtggctttatgaggcttcgattgagtgatatggtaaaagttttcataccaaatactcagctctgtcaagtattactggtgtagaatataatgggagtgcctgcagagagatgtattacacaaagctttgatctgatcctctctcagtggataacttagagctaagagctatacttgaaacacaacgtaatgtttcaaaataaatttttgccattatctgctgtataaattagaaaatataaacttctctttcatgcagaaataaaaaaggtcttggaaattccaagaattactagttttaaaaacttatattctcctaacaagctcttacattttcctatttctttttctttcttttcatttttttttttttattttggagacagagtcttgctctattgcccagcctggagtgcagtggtgccatctcagctcactgcaacctccacgtcctgggttcaagcaattctcctgcctcagcctcccaagtagctgggactacagtcatgcaccaccaatcccagctaatttttatattttttttagtagaggtgaggtttcgcaatgttggccatcatgctttcaggtgatccgcccacctcggtctcccaaagtgctgggattacaggcatgagccaccgcacccggccaacattttcctatttcaatactactttgtaccatagagattttaaatgttggaatatacagtagaagaatttgaaacctcatcttatatttttaaagcagaatatttaagtaatggaacccaaatgccaataaaatggcacaacattattatctgatgagaaggtttgacaccaacataactgaattataccacagttaagttttagaagtgaaaatctttgttttaaaaaatgcacataaaatattcataatcaaaaaaaaactttggtgacccatatttctttttttaaaagatagctgatactttatattatttcaatacatgatatcattagttttgagtatgaatttatgtttagaaccttttccttttgcttttcagtttaagatatgtaaaaataaataatatccctaagatacagttgtagatcaaaatattgatgatactagtttttacctaatggaaagtatttatgcttatatttacttgttcctcatttagggaaattcaaccaatttggaggttaaatctacttttctacattgcttattgaaaacacttaaacaatacataagtatagattcaatgggccccttctttcatcctgtgcccctaacttccactctcctaggtcaaaccactttatactttcaatagtttggatgtttgtcctccaggtaacattttattctcttatgtggcttgctttttctccctccttctcttctttcttgtcacctcattctctggctccctcccccaatttacaatatacatcctgatctacctctgttcttccagcttggcttggagaagaactggcagatgaacacgtcctgcatggtggaatgccctgtgaactgtcagctttctgattggtctccttggtcagaatgttctcaaacatgtggcctcacaggtttgtttgtaccataacttatattaggctactggtcaaggaatatgaaataaaatatccctcttgctttaacccatatcaaataatcttcagaaaggttggattggttgtctttctttgcaaaacatctaagccttacttgttcctggattgcctcaggagatatcactgtgatgccttctcccaatgagatatatgcttgcaaaaccataacatatattaaaggtgcatcactttgtatctcttcaaggaaaaatgatccgaagacgaacagtgacccagccctttcaaggtgatggaagaccatgcccttccctgatggaccagtccaaaccctgcccagtgaagccttgttatcggtggcaatatggccagtggtctccatgccaagtgcaggtatcaaatctcaagaagttgtcaggaagtgtgtactctatctgcagagacttcatctgcagaaaaacataaaaataatgtgttagaaatatgtttcagagctcacagatgacaagcttcttaaaatttgtatgtacttgccattttataaccatttaattagttttgataacaaaaactccatgccctatatttttaaaatcatttggagactgattcattttaatgaaaatttattttcctgtctttagctaggaaacaaattgttcaatgtatgctttattgctagtgccctatagggcttcttccctagggtttcaaatccttctctaaatgttcataaatcaaagtcagtggtgcagagataactaagtgatgagctctctaatgaagtatttctctttttctaattagttatttcttcctccattccaggaggcccagtgtggagaagggaccagaacaaggaacatttcttgtgtagtaagtgatgggtcagctgatgatttcagcaaagtggtggatgaggaattctgtgctgacattgaactcattatagatggtaataaaaatatggttctggaggaatcctgcagccagccttgcccaggtaacaacggcaaaggagaattcatattctgattattttttcctaggacaagggccgtgaaggggttgcatataaagtataagttacaggatgtcaacagtcttcttattcagtaatatctatgccaacagctcaacactatgcctgtggggaacgggacgctgtctcattactgccaggtagggttgaagtccaggtctcccatgtggcctctcaacaccctctggagttttaacatctgcaggagatggtatttaaggccttaagcccatgctccacagaaaagttatgaaataaaagatgagaaaataaggacaaaacataacctattcgggatttccagaagagagaaagagaggccaatgtttaaatacataatggctaaaaacagattaagtcctcataataacagcttaccctgggtccagggtagaatgaacaacaaactcatacctagataaatgtagtcaaaacataaaatatagaaaaataattagtaaagtcttcagtaagaaaataacagattatctacaactggaagacaaaatagcagtatggaggaaactattgaaagatattattcagattcagtgttagacacaatgagtgcatgcagtaaaagtagaaagaaaattttgtttatcaaatagtatggaaaaaatggcagacagtgataagctaatatttatgaatttgggcttgatgcagagaattgtagaggaaatttaatgtcaaaatatgccagaaaacccatccttgaacaaggtatagataggggcaacaatttattagtggactggaaatgaacagattgaaaatgaattacctgtattttatccccaagtggaaaatttgtattctcccaatttgcttataattatgatttaaagattgcatctctttcacaatattttcttttgaatgtgacctcaaaatattaaaaattaaggatttggcaaaaataatggggcataaaacacattttctatataaaaggatgtgatttaagaaaattttaaaagtggataacatatatcaacaaaaatttgtaaatgggattgagtccctaaaacctggaaaaactgacatgggctagctatttattcactcatcgagttacttattccttcgtaaaaaaaaaaaaaaatcatttgagatgataaaaatggtagggtatagtttaagatgaactgaatgaaattgaacagtaaataaaataaccctgataggggttattttgaggacaagccccctagactctgaaaatatccaactattgtattgatctttgcacacatggatattttcatctacttcaggtcaagaactaaactatttttaaaaaccaaaaatctgaatagcagctccttctcaatgagtgtaaaggttcagctatgcaaggtgaataagttctagagatccgttctaagacatagtgcctgtagttaacaatactgtattgtatacctaaaaatgtgttaagtgggtagatctcatgttaaatggtcttatcacaataaaaaataaaatagaataaaataaaatttaaaaataaagtaaaagaaaagaaaatctgactttctaaagccaggcaaagtgttgctgccaacaaccttttgctgagccagcaattcccctttcacttcctgctgctgaaactagtctgatatcatttaagatctcacacacaattcaataaaatcattttgcttcactgcagacccagcctaaggctgtggcagcaggtgacagctccaggcagggccaaggactgaacctttggaccttgatgtactgaatggccatagaggcaacaaaaagtgacccttggctaaaagttgtaaggcctacttttccaaaaccaaatctccagcaccagtaataggattgttgtgacattcacaccattgagcagaacgggcatccttgtcagactgtggtatatgccttactatggacactcctcacatgatttcattatactttctgcagcacacacactcactcatttgactgttacttatcaaatgtaattacaggtcaagccctggacttgaggccagagatacagtgcagaccaagagaccctgtccttgtacagcttactttctaatggaaagaacaattgctaatctaatagtgacaataatatataatatataagattataacctgtggtaaatgatgtgaaggaaaattacaggatcccatgataacatagagcaaacacattgttttaattaaagtaattgcaaatctaggaggctgctcttctcttctaaattacaatctattcatttcagttcctctcttgctagttttctctaatgatgggttttgaaagctggcagtatgtgaactaataagctttaaagagtagaatactaaattaggaaatacatctcatgtgtttaattgtcatatctttggcaggcatcgggtaattttattgttattacaatggtttacatggtcaaaatagaaaagtgtgtttaggacaagggagtatctcactctcatttgctgttattaaatctttgaagcctgacatgtattacttaggggcgaaaattacataactcacagactatcattaaaagatttattacattttgttgcaaaataaatgatgctaaatgtgaattgccacaaagataaagcctactggtgaaaaggtatgttttctttccatgtaattttcaatcactgaggtgaaattttattacattcatattgacaggaatttttttaactttagcagttttcctacataattaaaaactgagtaactccaaagtgacatttcctaggaaataaaagcgtttctaaaactttctcagactatttagaaattctttctagtttctttttcctttgcatttccaaaatttactagaactttctgtacttcaggagtaccaattacattctttaataaaggcctacaaaaatcactccattttgctattacgtatatatatgttagtcaataattcatgtcttaccaggacttcttaggcatgacacaagaagtttttccattaatcagatctccaggcaactttctgctaataccagtcaccttcagcataatataaggcaatatgaattattcatatgacctggctataataaataagtgataagaaacccttgtgaatttgtgtctatcataattgactgtgtactctgaagagtatcactaagcagtcactctgaagaatggatgggttaatggaaagggtgtatttcataaaatcttttctgttcttaaaatggctaaagattttggaagcatggatgcactatggcccagcaattgcactcctaggtacatacccaacagaaatgcatatataagttcatcaaaagacttgtactgaaatgtttacaataacatgatgggaaaaatttacaactccccacatgcccatcagtagtagaatggatatctaaattatgatatattcacacaatggaaagttgtacgaatgaagaaattagaacttcataaatgtatgatggatttcacaaacataaatgagagaaagaagccagacaccaaaaagtacatatggtatgatttcatatatcacacaagggagggttttgagatcctgggaatgttctgttccttgatttgggtgttgatcacatggttatataatcagattatcgaaattcagctatcatctgtgcatctatgatatgtgatcattttacatgtttgttatccttcaataaatcaatattttaaagagaagttgattgaggatgtagatcagaggaaatagtgagcattatttccagtactgcaactgctcagttgtctctctcacctccactcatctgggaagaaataggaatgaaaacataaaaccagctctgtcggccttggatttcaaacttttcaaaattgtgaatacctagaagactaattctgtttatatttaggctttctttgagtgtaactcatgtgtaataaaccactttactatgataatgacaagaatgatagtaggttttgatcaaatatttgttgtatcctaagaagagatgaattacggtggatgagctcctgtcagccacaatttacctttgatatcattaagcaacacatagaccagtaatagccatacggaaaataacaatacatatacaaagttatacaattacaaatttacaaatattaaatgcttatttaaatcttataaatattatgtgtgcctgggataccagaaacattgcctactggggttggaattaaaatgattatcgggctggcttttctctgtggatatgggtgtaaattacaaatatgtgttttacaggtgactgttatttgaaggactggtcttcctggagcctgtgtcagctgacctgtgtgaatggtgaggatctaggctttggtggaatacaggtcagatccagaccggtgattatacaagaactagagaatcagcatctgtgcccagagcagatgttagaaacaaaatcatgttatggtgagtgctaccgttcatatactctatcttaagcaaaagcataagattaaaaaaaaaatagtctgttaaaaataaacaaagttggccacgtgcggtggctcacgcctgtaatcccaacgctttgggaggcctaggtgggcggatcacctgaggccaggagttgtgagaccagcctggccaacatggccaaacccaaactctaccaaaaaaaaaattatgcatggtgtcaggctcctgtaatccaagctactcaggaggctgaggcaggagaatcacttgatcccgggaggccagagactgcagtgagccgagattgcaccactgcactccagcctgggcaacaagagtgaaattccatctcaaaaataaataaataaataatttaaaaatttactcagatgtcacttgaggctgaggactaaagtaaggggaagattctgaattctaaagattggaaagatggaacatcctgccacccttcataaataaggtgtgagttttgcaaaaatgtttcccggttttatgagctcaagaaggctgagataattaggagcacattatttgtacgcttataacaattatgatcaggtaggagtctaacaatcttcaatttatttaaatcaaatgacacaattaaataaaaattacaaatccacagcaaagtgtgagattttactatattttttcaaatggataaatcaaattattggtaaaaattgattttaatctgaattttacttagaatatatataaacatctatgtttatatgtctgtgtgaacgtatacacacatagaatcattcactcaatgtaagcaatacatcttcaagaatcacagcattaaatgtcgtggtttgggaaacaacacccgaagactcgaaaacaaaagaattgctatttggtagagggtgtggggctcaacaaacaacccttaatgctgctgatgttctgaaataagtaatatgacatagtagcaagtaggagacaaaatatcacctttcttactgaaaagtaggagacaaaagcttaaagtgttggaaaagaatacttgcagtaaaaaccaaatgggctagatgacttagcccaagaattagatggaattacctgctctgtcaatttgatcttcctaaatttatcaactaggtaaaacactccatatgccagcataggataagtaaagagtaaagaaaggtcaaaagttacaataaataaaataattcccaaggcaagaaagaaaagtattcactccaaaatgacaaggaaataaaattaggaatcaatagaacaatgacaaaagagatctccacacgcacaccttagagagtaaaatcatacctctaaagcattatccagcaaatgttatatgggatgcagcaaagaagtacctagaggagatcttgaagctttaaacgcttctacagaagggagaaaagttaaaaatgaactaagcattcaactgaataaattcttttttaatttttttaattatactttaagttctaaggtacatgtgcacaacatgcaggtttgttacatatgtatacatgtgccatgttggtgtgctgcacccattaactcgtcatttacattaggtatatcttctaatgctatccctcccccctcccccgaccccataacaggccgcagtgtgtgatgttccccttcctgtgtccaagtgttttcattgttcaattcccacctatgagtgagaacatgcggtgtttggtttttcgtccttgccatagtttgctcagaatgatggtttccagcttcatccatgtccctacaaaggatatgaactcatccttttttatggctgcatagtattccatggtgtatatgtgccacattttcttaatccagtctatcattgatggacatttgggttggtcccaagtctttgctattgtgaatagtgccgcaataaacgtatgtgtgcatgtgtctttatagcagcatgatttatagtcctttgggcgtatacccagtaatgggatggctgggtcaaatggtatttctagttccagatccttgaggaatcgccacactgtcttccacgatagctgaactagtttacagtcccaccaacagtgtaaaagtgttcctatttctccagatcctctccagcacctgttgtttcctgactttttaatgatcgccattctaactggtgtgagatggtatctcattgtggttttgatttgcatttctctgatggccagtgatgatgagcattttttcatgcgtctcaactgaataaatttttaagaaaagcaaaaaggaaatggaatgcaaccaacatggatgagtataaattcagtgagacagaaaataatcaacaaaaccaatagattgtttttagagcaaactgacaaaatagaccagctcatggcaaattcagtgaagaggaaaaaaaaagcaaagttgtcattaccataaataaaataaagtttagaaaaatagaatataattcggtgaatagctttttctaacagaagtaaaaatgtcaagataatttagaaggttatattttatcaagagtaatgaaaaacctacaccatagattatataactattttcaaacctatgaaatacatactcacatatgcacacaaactaaaatttaaatggctttaattatgagttttcccaaaatttaaagaaacagacaactccttgttgagatttgatcaggctggtgggaaaaataccagttatgatagccacaaaacccttttggaaggcctgagggttttcacatgactttggtaatagacctggtagaaggcggcctagtcccattacctttagttaaatagattagagtagtaaacaacgggatgtgaggaagttatctagttagcttgtttacccacgtggtctcaagatgagcctttgatacatgctttttactctttaagtccacaatgtcaattaccgtctaatggcattgactcaagcttttgttaactaataaatgtgagtctccctcactgatcagggctggctgcagtgacaaacctctctggtgtgtagatggtcagacactcagcaggactggcaaaagataatatctgtgtgtcagtgtacgttttattcatccatcgctggggtcagggtctgcagacagacccccgtagctaatgccctcttgtgaggagcaatacttcaactcctacttacgtgaaatctttttttttataagaacatattcttttcttaatatgaattacatttagtttctttttttaattatactttaagttctggggtacatgtgcagaacgtgcaggtttgttacacaggtatacacatgccatggtgatttgctgcacccatcaatccatcatctacttcatctactttacgtatttctcctaatgctatccctcccctagcccctacccctcgacaggccccagtgtgtgatgttcccctccctgtgtccatgtattctcattgttcaactcccaattatgaatgagaacgtgcagtgtttggttttctgtttctgtgttagtttgctgagaatgatagtttccaggttcatccatgtccctgcaaaggacatgaactcatccttttttatggctgcatactattccatggtgtatacgtgccacattttcttcatccagtctatcattgatgagcatttgggttggttccaagtcttcgctattgtgaacagtgctgcaataaatataaatgtgcatgtgtctttataatagaatgatttataatcctttgtgtatatacccagtaatgggattgctgggtccaatgaatcaccattggaatcaccatgctgtgttccacaatggttgaactaatttacagtcccaccaacagtgtaaaagcattcctgtttctccacatcctctctagcatccattgtttcctgacttttaaatgatcactattctaattggtgtgagatggtatctcattgtggttttgatttgcatttctctaatgaccagtgttgatgagctttttttcatgtttgttggctgcataatgtcttcttttcagaagtgtctgttcatattcttcgcccactttttcatggggttgttgttttcttgtaaatttgtttaagttctttgtagattctggatattagcctcttgtcagatggatagattgcaaaatttttctcccaatcagcaggttgcctgttcactctgatgatagtttcttttgctgtgcagaagctctttaattagatcccgtttgtcaattttggcttttgtggccattgcttttggtgttttagtcatgaagtctttgcccatgcctatgtcctgaatagtattgcctaggttttcttctacggtttttacggttttaggtcttgggtttacgtctttaatccatcttgagtgaatttctgtataaggtgtaaggaaggggtccggtttcagttttctgcatatggctagccagttttcccgacaccatttattaaatagggaatccttttcccattgcttttcttaggcttgtcaaagatcagatggttgtagatgtgtgttattatttctgaggcctcggttgtgttccattggtttttatatctgttttgctaccagtaccgtgctgttttggttactgtagccctgtggctgtgggtttgacataaatagctcttattattttgagatatgttccatcaatacctagtttattgagagtttttagcatgaaggggtgttgaattttgtcaaaggcctcttctgcatctattgagataatcatgtggtttttgtcattggttctatttatgtgatggattacgtttattgattcacatatgttgaacccgccttgcatcccagggatgaagccgacttgatcatggtggataagctttttgatgtgctgctggattcgatgtgccagtatgtgattgtggattttcacatcaatgttcatcagggatattggcctgaaatttgtttctctttattgtgtatctgccaggttttggtatcgggatgatggtggcctcataaaatgagttagggaggagtccctctttttatattgtgtggagtagtttcagaaagaatggtaccagctcctctttgtacctctggtagaatgtggctgtggatctgtctgttcctgggctttttgtggttggtaggctactaattactgcctcaattttagaacttgttattggtctcttcagggattcagcttcctcctggtttagtcatgggagggagtatgtttccaggaatttctctcttctaaattttctagcttatttgtgtagaggtgtttatagtatgctctgatagtggtttgtatttctgtgggatcggtgatgatatcccctttatcattttttattgaatctatttgattcttctctcttttcttctttcttagtctggctagccatatatctaaattgttgatcttttcaaaaaaacagctccttgattgatttttttaagggtgtttcatgtctctatcaccttcagctctgctcttagttatttcttgagttctgctagcttttgaatttactcttgcttctctagttcttttaattgtgatgttaaggtgttgattttagatctttcctgctttctcctgtgagcatttagtgctataaatttccctctaaacacagttttagctgtgtgccagagattctggtatgttgtgtctttgaactcattggtttcaaataacttacttacttatttctgctttagttttgttatttacccagtagtcattcaggagcaggttgttcagtttccatgtagttgagcggttttgagtgggtttcttaatcctgacttctaatttgattgtactgtgtctgagagactgtttgttatgatttctgttcttttggattttctaaggagtgtttgttttacctccaactatgtggtcaattttagaaaaaatgcaatgtggtgctgagaagagtgtatattctgggccgggcacggtggctcatgcctgtaatcccagcactttgggaggccgaggcgggcggattacaaggtcggtagtttgagaacagcctggccaatatggtgaaaccccatctctactaaaaatacaataatcagctggacatggtggcgggtgcctgtagtcccagctactcgggaggctgaggcaggagaatcactttaacctgggaggtggaggttgcagtgagctgagatagtgccactgcactacagcctgggtgacagagcaagattctgtctcaaaaaagaaaaaaaaaaaaaaaagaatgcatattctgttgatttggggtggagagttttgtagaagtctattaggtctccttggtccacagcttagttcaagtcctgaatatccttattaattatctgtctcattgatttgcctaatattgacaatggggtgttaaagtctcccactattattgtgtgggagtctaactctctttgtaggtctctaagggcttgctttatgaatctgggtgctcctgcattgggtgcatctatatttgggatagttagctgttcttgttacattgatccctttaccatatgtaatgctcttctttgtctcttttgatctttgttggtttaaagtctgttttatcagagactaggattgtaacccctgctttttttttttttgctttccatttgcttggtaaatattcctccatccctttattttaagcctatgtgtgtctttgcacgtgagatgggtcacctgaatatagcccaccaatgggtcttgacttgttattcaatttgccagtctgtgtcttttaattggggcatttagcccatttacatttaaggttaatattgttatatgtgaatttgatcctgtcattgtgatcctagctggttattttgaccattagttgatgcagtttcttcatagtgtcgatagtctttacaatttggtatgtgtttgtgctgggtctgtcccacagaccctggccgaccgatgaatgaaatgagtactcggccacaggtatgcagtgtaagagcagctaggcgtctgcctggctatagctgccaaagtgcagccccgagaagctggagctgcatgcttttattcagtgtaggcgtgattccaaaagcctggagcaaacacaatctgtgggtaactaacatttattgttcccctttcaaggaacatcacgtgtgcgggtgatcaaagatcggttcttggtcaacacaagtaaacaagcctgtttaagataaattcccctacactcccttgtacctactccttgccctctgcctcagggtcagagaacagctgcctttggctattctcccgcaaagccaggcagagccttcgcacctttccgaaggcctgctcctttccctatagtttctcccaccactctgactgatctacatgtttgcagtggctggtaccagttttttctttcaatattgagtgtgccctttaggagctcttgcaggcctgctggtgacaaaatctctcagcacttgcttgtctgtaaagaattttatttctcctttgcttatgaagcttagtttggctggatgtgaaattgtggattgaaaattctttaagaatgttgaatattggatcccaatctcttctggctcgtaggatttctgcagagggatccactgttagtctgatgggcttccctttgtgggtaacctgacctttctatctggctgcccttaacatttttttcgttcatttcaacctttgtgaatcggatgattatgtgtcttggggttgctcttctcaaggagtatctttgtggtgttctctgtatttcctgaatttgaatgttggcctgtcttgctaggttggggaagttctcctggataatatcctgaagagtgttttccaacttggttccattctccccatcactttcaggtacaacaatcaaaggcagatttagtcttttcacatagtcccatatttcttggaggctttgtttgttcctttttattcttttctctctaatcttgtcttctcactttatttcattaagttgatcttcaatctctgatattgtttcttctgctttatcgatttggctattgatacttgtgtatgcttcacgaaatttttgagctgtgtttttcagctccatcaggtcatttatgctgttatctaaactggttattcttgttagcaattcatctaacttttttcaaggttcttagcttccctgcattctgtttgttagaacgtgttcctttagctcagaggagtttgttattactcaccttctgaaggctacttctgtccatttgtcaaaatgattcttcatccagttttgttcccctgctggcgaagagttgtgatactttggaggagaggaagcatttgggtttttggattttcagactttttgtgctggtttttcctcgtcttcatggatttatctacctttgatgttggttaccttcagttcggggtctctgagtggacatccttttttattgatgttaatgctattcctttcttcttctaacagtcaggaccctctgctgcaggtctgctggaggtccactccagaccctgtttgcctggatatcaccaacggaggctgcagaacagcgaagattgctgccagttacttcctctgaaaacttcatcccagaggggcacctgccagatgccagccagagctctcctgtatgaggcatctgtcaacccctgctgagaggtatctcccagtcaaagacacaggggtcagggacccacttcgggagagagtatgacccttagcagaggtcaaacactgtgctgggagatctactgctctcttcagagccatcaggcagggatgtttaattctgctgaagctgcacccacagctgccccttcccccaggtgctctatcctatcccagggagatgggagtttgatctataagcccctgactggggctgctgcctttctttcagagatgccctgctcagggagaaggaatctagagaggcagtctggctacaagggctttgcagagctgtggtgggctctgcccagttcaaacttcccagcagctttgtttacactgtgaggagaaaactgcctactccagtctcaataatggtatacacccctcctcccaccaagcttgagagtcacaggtcatcttcagactgctgtgctggcagtgagaatgtcaagccagtggatcttagcttgctgagctctgtgggggtgggatccactgagttagtccactcagctccctggcttcagccccctttccaggggagtgaatagttcggtcctgctggtgctccaggccccacttgggtatgaaaaaaaaactcttgcaactagctcagtgtctgcccaaacagccacccagttttgtgcttgaaacccaaggccctggtggtgtaggcacccgagggaatctcctggtctagtgggttgcaaagaccatgagaaaagcatagtatctgggccggaatgcaccattcctcatggcttcccttggctaggggagagagttccccaacccctcgcacttcccaggtgaggcaacaccccaccctgcttcagctcaccctccatgggctgcacttactgtccagccagtcccaatgagatgagccaggtacctcagttggaaatgcagaaatcacccaccttctgcatcaatctcactggaagctgcaggctggcactgttcctatttggccatcttggatccaggatctccctatgtgaaatcttaaaaaaagaagttgagattctgggcaagatggccaaataggaacagctccggtctgcagatcccagcgagatcaatgcagaagatgggtgatttctacatttccaattgaggtacccaattcatttcattgggactcgttggacagtgggtgcagcccacggagggcaagctgaagcaaagtggggcattgcctcacctggggagcgcaaggggtcagggattccctgccctagccaagggaagctgtgaaagactgtgaacggtgtactccagcccagatacatcgcagtctttgcaacccgcagaccaagagattccctctggtgcctccgccaccagggccctgggtttcaaccacaaaactgggtggcaatttgggaagacacctagctagctgcaggagctttttttcataccccaatggcacctggaatgccagcaggacagaaccattcactgccaggacagaaccattcactgccctggaaagggggctgaggccagggggccaagtggtctggctgggcaggtgccacactcacagaacccagcaagctaagatccactggcttgaaattctcgctgccagcacagcagtctgaggttgacctgagatgctcgagctggggaggggcgtctgccattactgaggcttgagtaggctgttttaccttcacagtgtaaataaagtcaccaggaagttcaaactgggcagagcccacaacagctcagcaagtctgctgtggccagaccgcctttctagattcctcctctctgggcagggcatttgtgaaaaaaaaggcaggagccccagtcaggggctaatagataaaactcctatctatctccctgggacagagcacctggggcaaggggcactgtgagtgcagcttaggcagacttaaacatccctgcctgatggctctgaagagagcagcagatctcccagcacagcatttgatctctgctaaggaacagactgactcctcaagtgggtcccgaccccacgtctcctgactgggagacacctcccagtaggggacaaaagacacttcataaaggagagctctggctggcatctggcaggtgcccctctgggatgaagttttcagaggaaggaacaggcagcaatctttgctgttctgtagcctctgctggtgatatccaggcaaatagggtctggagtggacctccagaaaactccagcagacctgcagcagagggttctgattgttagaagaaaaattaacaaacagaaaggaatagcattaacatcaataagaaaggacgtccactcagagaccccatccgaaggtcaccaaaatcaaacaccaatggtagataaatccacgaagatggggagaaactagctcgaaagggctgaaaatttcaaaaaccagaatgcctcttcccctccaaaggatcacacctcctcaccagcaagggaacaaaactggacagagaataagtttgacgaattgacagaaggtgggtaataacgaactcctctgagctaaaagagcatgttctaaccaaatgcaaggaagctaagaaccttgaaaaaaggtcagaagaattgctaacatgaataaccagtttagataacaacataaatgacctgatggagctgaaaaacacagctcaaaaatttcgtgaagcatacacaagtatcaatagccaaatcaataaagcagaagaaacaatatcagagattgaagatcaacttaatgaaataaagtgagaagacaagattagagagaaaagaataaaaaggaacaaacaaagcctccaagaaatatgggactatgtgaaaagactaaatctgcctttgattgttgtacctgaaagtgatggggagaatggaaaacactcttcaggatattatccaggagaacttccccaacctagcaagacaggccaacattcaaattcaggaaatacagagaacaccacaaagatactccttgagaagagcaaccccaagacacataatcatcagattcacaaaggttgaaatgaacgaaaaaatgttaagggcagccagatagaaaggtcaggttacccacaaagggaagcccatcagactaacagtggatccctctgcagaaaccctgcaagccagaagagagtgggggcccatattcgacattcttaaagaaaagaattttcaagccagaatttcatatccagccaaactaagcttcataagtgaaagagaaataaaattctttacagacaagcaaatgctgagagattttgtcaccaccaggcctgccttaccagagctcctgaaggaagcactgaacatggaaaagaacaactggtaccacaaacgtaacaaattgtaaaggccatcaacactatgaagaaactgcatcaactaacaggcacaataaccagctagcatcacaatgacaggatcatattcatacataacaatattaaccttaaatgtaaatgggctaaatgcccccagttaaaagacacagactggcaaattggataaagagtcaagacctatcagtgtgctgtgttcaggagacccatctcacgtgcaaagacacacataggctcaaaataaagggatggagggatatttaccaagcaaatagcaaaaaaaaaaaaaaaaaaaaaaaaaaaaaaaaaaaaaaagcaggagttgcaattctagtctctgataaaacagactttaaaccaacaaagatcaaaagagacgaagaagggcattaaatatggtaaagggatcaatgtaacaagaacagctaactgtcttaaatatagatgcacccaatgcaggagcgcccggattcataaagcaagttcttagagacctacaaagagacttagactcccacacaatttaacacaccactgccaataatagactgatcaacatgacagaaaattaacaaggatattcaggacttgacttgaactcagctctggaacaagcagacctaatagacttctacagaactctccaccccaaatcaacagaatatacattcttctcagcaccacatcacacttattctaatagtgaccacataattggaagtaaaacactcctcagcaaatgcaaaagaacagaaatcataaacagtctctgagatcacagtgcaatccaattagaactcaggattaagaaactcactcaaaactgcacaactacatggaaactgaacaacctgctcctgaatgacttactgggtaaatattctctgaaagcaatgagaacacagactcaaagtaccagagggaagtttatagcactaaatgcacacaatagaaagcaggaatgatctaaaatttacactctaacatcacaattaaaagtgctagagaagtaagagcaaacaaattcaaaagctagcagaactgaaggaaatagagacacaaaaaactcttctaaaaaatcaatgaatccattacctggttttttgaaaagatcaacaaaatagatacactgctagccagacgaagaaagaagaaaagagagaacaatcaaatagatgcaataaaaaatgataaaggggatgtcaccagtgatcccacggaaattcaaactaccatctgagaatactataaacacctctatacaaataaaataggaaatctagaagaaatggataaattcctggacacatacatcctccaaagtctaaaccaggaagaagtcgaatccctgaatagacgacaagttctaaaattgaggcactaattaatagcctaccaaccacaaaaagtccaggaccagatggattcacagtcaaattctaccagaggtacgaagagaagctggtaccattccttctgaaacgattccaatcaatagaaaaagagggaatcctccctacctcattttatgaggccatcatcatcctgataccaagacacaacaaaaaaaaaaagaaaatttcaggccaatatccctgatgaacattggtgcgaaaatcctcaacaaaatactggcaaactgaatccagtagcacatcaaaaagcttatctaccacaatcaagtcggcttcatccctgggatgcaaggctggttcaacatacgtacatcaataaacataatccatcacataaacagaatcaatgacaaaaaccacatgattagatgcagaaaaggcctttgtcaaaattcaacacccattcatgctaaaaattctcaataatctaggtattgatgaaacatatctcaaaataataagagctatttatgacaaacccacagccaataccatactgaatgggcaataactggaagaattccctttgaaaactggcacaagacaaggatgccctctcttacgactcctattcaacatagtatgggaagttctggccagggcgttcaggcaagagaaagaaataaagggtattcaaatagtaaaagaggaagtcaagttgtctctgtttgcagatgacatgattgtatatttagaaaaccccatcatatcagcccaaaatctccttaagctgataagcaacttcagcaaagtctcaggatacaaaatcaatgtgcaaaaatcacaagcattcctataaaccaataacagaaaaacagccaaattatgagtgtacttccattcacaattgctacaaagagaataaaatacctaggaatacaacctacgagggatgtgaaggacctcttcaaggagaactacaaaccactgctcaaggaaatcagagaggacacaaataaatggaaaaacatcccatgatcatggataggaagaatcaatattgtgaaaatggccatactgcccaaagtaatttacagattcagtgctatccccatcaagttaccattgactttcttcacagaattagaaaaaaactactttaagtttcatctggaacaaaaaaagagcccgcatagccaagacaatcctaagcaaaaagaacaaagctggaggcatcatgctacctgacttcaaaccatactacaaggctacagtaaccaaaacagcatggtactggtaccaaaacagatatatagaccaatggaacacaatagaggcctcagaaataacaccacacatctacaaccatctgacctttgacaaacctgacaaaaacaatcaatggggaaaggattccctatttaataaatggtgtcgggaaaactggctagccatatgcagaaaactgaaactggaccccttccttacaccttatacagaaattcactcaagatggattaaagacgtaaacccaagacctaaaaccgtaaaaaccgtagaagaaaacctaggcaatactattcaggacataggcatgggcaaagacttcatgactaaaacaccaaaagcaatgggcacaaaagccaaaattgacaaatgggatctaattaaactaaagaacttctgcacagcaaaagaaactatcatcagagtgaacaggcaacctgccgattgggagaaaaattttgcaatctatccatctgacaaagggctaatatccagaatctacaaagaacttaaacaaatttgcaagaaaaaaacaatgccatcaaaaagtgagcaaagaatatgaatgagcacttctcaaaagaagacattatgcagccaacaaacatgaagaaaagctcatcatcactggtcattagagaaacacaaatcaaaaccacaatgagataccatctcacaccagttagaatggtgatcatttaaaagtcaggatacaatggatgctagagaggatatggagaaacaggaacgcttttacactgttggtggaagtatcaattagttcaaccattgtggaagatagtgtggtggttcctcaaggatctagaaccaggaacaccattggcctcagcaatcccattactgggtatatacataaaggattatgaaccattctattataaagacacatgcacacatatgtttattgcagcactgttcacaatagcaaagacttggaaccaacccgaatgcccatcaatgatagactaggtaaagaaaatgtggcacatatacaccatggaatattatacatccataaaaaaggatgagttcatgtcctttgcagggacatggatgaagctagaaaccatcattcttagcaaactgtcacaagaacagaaaaccaaacaccacacatgttctcataagtgggagttgaacaacgagaacatatggacacagggaatggaacatcacacaccggttcctgtgagggggtggaggtaagggggagggatagcactaggagaaatacctaatgtagatgacaggttgatgggtgcagcaaaccaccatgtcacgtgtatacctatgtaacaaacccccagttactatgagagtataaccttggcagtaaaaccagttaaaaataaagttacttatgaaagtagatgtcaaaatcataaaaataaaatattagctaaccaaattaatatttaataatatgactataattgttgaaatacaaagataaccaaataattgttgaaatacaaagataaccaaatattaataaaatctcttaatgtaatttatcacattaacagaaataaagatataattttttatacacattaaaaggtatttctaaaattcagttcactttcacaataaaaacttgtagaccaaacttgaactagaagagaatctttttacttaataaataaggtctatcaaaatttacacaaacatcataatacatggggaaacattagaggcaggctcttggaatcaataacagaacaaggataccactgttgccacttattttcaacctagtgaaggaggttccagccaagtgtcatcagaagtttaagaattgaaaatgaaaaaataaaattatcattctcatagtatatgaatttcacattttagacaatcaagataatttatagacgactgtttggaagtaagaaaattcagaaacattgtacaatttaaaaaccaatacacaaaataaatagtcttttttttttttttaaccagcaaaactgttataaaattgaattggaaaaagctgcattgacaataaaactaaaactataaaaaataaatgcaaccaaaatcatctaagataggtatgaaaaattataaaatcttattggaagatatgaaactaaaacgttggtgaaaatgtttatgaataaaaagccccaatattataacatgtaaattttatacagatttacctataaaatctatgcaatttgaacaggttgttaatgtaatctgagaaattgatcctaaaattaagtcagaggagttaaaggccaagaagatcccagaatgtttttaagaaggaaaagtgggagactaattcaagggacttacatggctttatatcaagacttactctaaagcatcaatagttaaaaagggtaattgatcaacaattaagccattagactaaaagaatagaaaagagaatctccacgacaaattcttatgtaggtaagtaagtggcagagggaaagtcagtgggagaatgagtggatgaataatattgccaaaatgtgttatccatatcaagttttaaaaaatatctttagcttacatcacatacaaaactatattttcaataaattatagacctaaagatgaagaacaaactgtaaatactaaatataagaggatattttcatgaactcaaggtagagaaggatttcctaaatatgacaccaaaagcacaaacaaaaatgaaaaaattttaaatttctttaaattaaaatttaaaacttctacacagtagaaggttacaggacaagccacaaacttgaaaaatatacttatgaagccaattaatttcaaaggattcatgtctagaatagcaaatctagaactttttgatccaaaacaagttaatagtcttaaaattgttgaggacctgaaagaactgttcttttctgacatgtataattttaaaaatagaaaacttataatatttattaatttatttaaaatgatcaaaaaacaaaattgtatgttactataaataacaaatttcctgcaaaataagttcaccataacaaatggaaaataactttaatgacgagagtggtcttgtttggatttttgcaaatctctgtgaagtctaacttaagacagctggattctcttatctgcttctgcattcatcttattgcaatcttattttagtttatgtatgtaaagaaaatccaaccttacacagattgtagttgcaaagaggaaatcctcactcacactctgaaagaatgtcagtgtctcccagggtctctgaaccgcactttaagaatcactgttccagaatgaagaatttctacaattcaatgagaaaaaatatagaaggccaaatgtttaaataagcagcttgcataccaggagatccaaatgtcctgaaacatttttgttactgttcaataactttagtaatcaaggaactttaatttaaaatgacaagataactttccatacccaaaagactaaccaaaaaaaattaaaatctggcaattataaattttcatgagtgtttagagcaatggcagtctttatgcactactgatggatttgtaaattgtcaccttttgcaggaaaaaaatgggcaatatttaataaagtttcagctagccatacagtgataccaagaaatttcccttctagatatgtaatttaaagaagcaccaggccatttgcacacagttgaccttcagagcattgtttgaataacaaaattaaaaataatctaatagaaaaatagctaaataaactgtgttatgtagtacaatggaattctatgtagccgttaaaataaactgactgtactacattttttaaaatcacttagaagtatttcacctgtaacattgactaagtttcagaatgctacacagaataggatacatttttaaaatttatgactgtatgaaagtaataccatatatcatttctgtatatagtaattatgtgtgtgtgcgtgtgtgtatagtgaaaaaattaaaagcatggcaaagaaagtcatacatcttcagaatagtatgtattgctggacagacagggagggtgatcagaacagaaaagaatataattatatatctcatgttttattcatcaacaagctaatgaaaactgaggcaaatatggataaataatatttgttaaaattgcatgatgggagatatatatatatatataactatatatatatacagttattctctatacctggctgcatatttatttcataatattttttaaaaattaaattaaaaacctaggttcccaccaggtagtgtgacagcagacatggaaaattagttgggattgaggtatatagctgcaattttaaacatatgcatggcaacttcaggacaataaattgacatttgaatcatcagagatgagcttattacttttcagtaatatgttattaatactctatccccatgattgtccttctgggtaacagaatgcttctgctaatgtttattatttccctgcagatggacagtgctatgaatataaatggatggccagtgcttggaagggctcttcccgaacagtgtggtgtcaaaggtcagatggtataaatgtaacaggtaaacctccagtttctctttgtcctttgaaaatcttcctgtaacacacatgtgattggttgaagaaaataattaaggaaacaaagttactctttcagtattcaaagcctgtttgggattcaggatgcctaagctgtatatacccatctggtgaccaatgacaaattattttattttataggtggttcaaattatctctcacctagcctttttaggtattgctgctgaaacttaattaaaatactatctaattctaataaataattgttataaataattttcagatcttttctagaaattttatatatgagtaacttactatatgtttaaaaatcaatttttttgactttctgcttctgtgccttgaaggcaatataaatgcagaccaaaaataccagcaagggaatatgattatacaaatccaaataccttgcttaaattcagaagtctatgatttagagatttttaaattaattaatagggaagacctactggtaaatttcaaacccagaccatctgagcagctgacctactgtgcctgcatccccaaattattatatatccaaagaagaaatccaaaggaagaactttatttgattgtacttcgaccaacatatacctccaaagaactactctagtgtggaattactaaaagcctatctgaagcctgtaagcgtgagggatcctaaggaccccttgaaggaggaagagactttggctcaagataggtagtgaaccaccaagcaaatttcctagaaagaaatacaagtcagaaccagaaccttaatttcaggcacatggacccagaaatctaagcctttccataagcaatttctttttataaatctaacttataggaattgccatagcatagcaacagcaggagtcttgacagttaactgctcaggcagacctgcttacttgctgctgttttgaccctgctgcgggggaaaaaacagtgtgcatttggatgcctctgagtgatgtttgtttagaaatttaactttaatatatacagtaagaaacaggagcaaggatcaatatggtttttgaaaactatccatctttatattgaattttaaattacctggatttattgaaacccaattacttatttcctccatatgggagctggatcaggatgtcaatttttttcttgtgaagatatgattttatacatgagaaagctctctcaagaaacccttaataataacaactccctgtggtcacatacggaacaaagaaaagacatctagtagaaaccctttgctctctcactgtattattttttgggagaaaaatctgctccatctaccccactctaagaggtatggagtgagaagagtcctgagagggatagacaggctttctgaatgaggaggtgttacagaagtcatccattgagctcagagattggaaacgaatgtctccattcttttttaaactattcaaagaaaatttaacagcttctctagatgatcctgtaagtttgcagttttttttcaataatggatgcaaataatatttacctgacttttcttctacatattcaaaactctttttccactgcaattggggctattcccccaatgcaaaggtaagtcgaattttaaaagacttacctataaaatcatatttttaatttcttttcaattcagcaaagtgtacaatggattatttctaatgctattcagtaccaaaaggccaatgtgtaaatgatttgtgttaagctctatatgcattcttctttcatcttttaggagagatgagattctttatgacaaatagacaagcatgtaaagtatattacctatcttgatcaattgctttaatttatgaattgtccttgtaagaaactcaaaatactgctttgtgtgtgtgtgtttaataataacttcagtgtggccaattaactgcgattgccttgcaatgactaactgcttttctgtgacaatttttctatgagtattttgtgattataatattgagagaaacacagacaattagcaataggcgcctgtgattaaattccagagaatcatcagttccataaataaagaaaaaattttgttttgctaaaattctgttaaactgaacaagtatagtttgaaaataggagcttccttcacgtcaccaatgttttttatgacatctatttccatcttaaaacctcacttgagacaaattaggcacagttggtactacacttgaaaataaacgagataaacagctgtaatatcaagttaaaaccatagtgcaaaacaaatgatttcgtagatacatttgttttcttctctatatccaaaaaacaccatgaattagcagaaattgtgacttttctgaaaaagaaatatgcattatttaaagaaaacatttatttaacataaagagctgaagagttatttcaaagtacgtgaaaactattgttttgaatctccaagaaagaattttaacttgaaatgaaatcagcttttcaattgctggacttggattcatgtgctcctgacagaaaaagcttgtgtgcaattagtattttcaaaatagcagctataaaatcattctttcaacaaatgcttgttgaatacctgctgagtaccaggcactgagctagctcccctgggtaaaaagggcctggagtcactacataaggtggtcaaggttaaccaaatatttcacagtcaaccactgacagaaaaattcctgggattcccaaggtggttcaagattcaaagacaagtcactaaccacagtgtattttcatcatagcaaaatatattatttgtcaaaacatgattttctgttccgcagggggctgcttggtgatgagccagcctgatgccgacaggtcttgtaacccaccgtgtagtcaaccccactcgtactgtagcgaggtatgtgaaaattcatcagggcagacaagccagctccatcatgtgtcaccccactgtctcttatgcagtttatcttcctccaaagaaagcatgtcttgaggcataaaaatcccattttagacatctccttttatcaatctaaaaagtcctgacttcacttgctttcacctttagaatacattttcatataatgccaaaagtatgtttctttgtagttaaaaataatagaggaattatgtatagtaattcccaaaacaaaccttgtttaaagccttctcttcaagtcaggtctgttagacttccaaagattccttgcatggctagtataaatcttcttgttctcctgcagacaaaaacatgccattgtgaagaagggtacactgaagtcatgtcttctaacagcacccttgagcaatgcacacttatccccgtggtggtattacccaccatggaggacaaaagaggagatgtgaaaaccagtcgggctgtacatccaacccaaccctccagtaacccagcaggacggggaaggacctggtttctacagccatttgggccaggtgaactgactagactagtgttgaaagagaaacctttagttcttttaggcaatgccaaaggattaaaaaagtgagcaaagcatttttatatgagctattgattattttatctacatgcatttattctgatagtgccatctattcttcaattttttactatcattatggaaaataactcatgtttgaagttcagagaaatgaaattacattcttctgagaaaaaattttggatcaatataattcaattcaattccagtccaaaaattacaagtataattaatttcaaattgaacaaagttagaaacatgaattttaaaaaatgtgttgtcattcagaactaggataaaggagactataaagacattccagaatttttcatttgatcataggaacagtaatagtttgacccttaaataaaaacatcactaatgcagttctgtgccagggcacacgtggtagctagaccagtttctattagccctaaaagtcagcatactcaaatacttggaatctgtactagtgccagataaacagggagacaatggagccttcccttctggataggatgatccaaatttgttttcacattcacagacagctcttaatgtatctggtaataaatgcaaagccaatacaggcaaatgcttgaatacctcatgatatgctattctctactctgcacactttccctcctcagttggatttcatcatatgctcatccctagaactaacctggtgcttgaaaatgtgctacatggattataaagcagctaatatgccactttttctcacaacctggaagaactactagtctatgaagtaatctccaggcagagccaggcatagtctactttaaaatgccattagaaacatgagaaaagatggaaggaatctgcatagctagcacatctccatttctatgcattaagtctgaatactttcccttattggagaataaatattggatttttaagatattttaagtgtttgggtgatttgcttttaatcacattattcctgctttaattggcttatttagctgatagtatgatttattttgcaaagctgacttatctgtgtaagcatgggaaactcttccctcagtgtttaagacaatggactagcagacaaccagtagcaattttgaccttcactaagaattgaagcagatctcctcagatcaaaaccagtccttttgaaaaaaaaaagaatattattgtcattattttaaattttatatatagtttccccaaagttaaaattttaaaatatttaaaaggtgcatgttctgaaaacttagatattctttgattttgaaaaaccccaaaaaacatttgttgaagaaactctcaacagagatcctcaatcgtggaacagctcttttgattctaaactgagctcaaatttaaaaaatgaaagctttaggattagaaagaaaggatatttagaatattaattgagtttattcccagcaaatgaacctctaacttgatctaactccgggcaaaaaaattccacagtaccaatttccatttgatgcctttcaaatattgaataaaccagagtctgtgtgaggtcaattttgcccaatctataattttaacactaagatcaaatatttaattgcaacagaaaatatatgttgatgtgaggatcaaattaaattagccaatatcattaataacatcttgtgcttgaagtttattcggagcatagaactgaggagttcaaagatgagaccagaaacccaaattacaaaagttcctgttatgtctgattccatataatagaaaaggtagaaaaaaaattatttatagatccttttatatgttaaccaaaccagttgtttttgaaaatgacattgtcagccaattttaaaacacattgtaagtgcagactagataaaagattattaattccataaaatcttaaatatattcactttcattttacctggaataaaaatgacaaagtttttgtttaaatacctatatgcattaactcgagtttgtagaaactttcttaaaattgcatttttcatcttttcttctcattgcaattctcaaaatacactgaaaatcagaagagaatgtttatatagcattacacatgtattgagtttgaagtaaaattgagatgaaaggcagctgaagtttagccaaagaaacttgaaatctgaagtcaaacatttataatttttcagttcagttttccttgatagcttatctttaatgaagcagaatctaactcataatagcagctttgcattaatcattaactgtgctgaagcaataattcttttcgggttttgaaagaaattggtcatatatgactgatcattggtcatagttaaagactgcctcatgtataccagactaatgtaaattaataactaatatccattcttcttagatgggagactaaagacctgggtttacggtgtagcagctggggcatttgtgttactcatctttattgtctccatgatttatctagcttggtgagtgtttaaataattaaaaatccaaagagatacttaatcgtaacacagaaacagcaaactaatgtctcaaataagtactctacatttatctggtgttcacatgaatttctaaataaacatggctttagtcctagatgggctaaaagctaccaaatctgagccatttcgtttctaaagatgagcaagagcttgctgcaggtcatcttctcgagtatgttctcttgcatactttcaagaaaatattgctttgtactcaatatggtgaactgtagatttttatattgaattactaatggaggaagatattacagtaatacctaatcatattcaagtatcttctaaaacatgtataatttataaattatgcattatttataaaggtttctggccaaatgaaaatgaccctactatgattttatttctgttgttaatactaaaagaatcccacttggataatttatcttttgtagggtagtgaaacacttgaagtttacttagagtttattcaaagcataaaactgaaattcaagatcagaaaatcaaattctaaggtagatagactttaggcaacgcaggcaacgaggcaatttcagtttatcaatttgcttttacttttttttcgcttaaagcaatcaaatttacaattagaaactgattttctttctcctaattccgaatttttttacagcaaaaagccaaagaaaccccaaagaaggcaaaacaaccgactgaaacctttaaccttagcctatgatggagatgccgacatgtaacatataacttttcctggcaacaaccagtttcggctttctgacttcatagatgtccagaggccacaacaaatgtatccaaactgtgtggattaaaatatattttaatttttaaaaatggcatcataaagacaagagtgaaaatcatactgccactggagatatttaagacagtaccacttatatacagaccatcaaccgtgagaattataggagatttagctgaatacatgctgcattctgaaagttttatgtcatcttttctgaaatctaccgactgaaaaaccactttcatctctaaaaaataatggtggaattggccagttaggatgcctgatacaagaccgtctgcagtgttaatccataaaacttcctagcatgaagagtttctaccaagatctccacaatactatggtcaaattaacatgtgtactcagttgaatgacacacattatgtcagattatgtacttgctaataagcaattttaacaatgcataacaaataaactctaagctaagcagaaaatccactgaataaattcagcatcttggtggtcgatggtagattttattgacctgcatttcagagacaaagcctcttttttaagacttcttgtctctctccaaagtaagaatgctggacaagtactagtgtcttagaagaacgagtcctcaagttcagtattttatagtggtaattgtctggaaaactaatttacttgtgttaatacaatacgtttctactttccctgattttcaaactggttgcctgcatcttttttgctatatggaaggcacatttttgcactatattagtgcagcacgataggcgcttaaccagtattgccatagaaactgcctcttttcatgtgggatgaagacatctgtgccaagagtggcatgaagacatttgcaagttcttgtatcctgaagagagtaaagttcagtttggatggcagcaagatgaaatcagctattacacctgctgtacacacacttcctcatcactgcagccattgtgaaattgacaacatggcggtaatttaagtgttgaagtccctaaccccttaaccctctaaaaggtggattcctctagttggtttgtaattgttctttgaaggctgtttatgactagatttttatatttgttatctttgttaagaaaaaaaaagaaaaaggaactggatgtctttttaattttgagcagatggagaaaataaataatgtatcaatgacctttgtaactaaaggaaatcaaaattatatgttgatttttctttctctctgatttcccagtttcagattgaatgtctgtcttgcaggcagttatttcaaaatccatagtcttttgcctttctcactggcaaaatttgaagcaatctctctcttcaatgtatgatttcaaaactaaaattttaaaagagaagaataaatatcttatccaagacttcattgcatatctagagcaagagtggcaaactttttctgtaaaggactatatagaaaatattttccacaaggtctatgttgcaacttctcaactttgccattctgctaatgcaatcttagtaaataaaagaatgaacataactgttttcctatataacttcccttacaaaaacagccagtaggccacctttgcaggtcatattttgctgacccctggtctggatgttttttaatgctagctctccatggtgtcatctttcgttttcattcatttttcaaaggtgagaatttacagtcattacatttcccactgtatcagaagtagctgtattttctacagatgtagccctgggaatggcacagtggaacaatatttaactaactcagcagacttcttgcaaatgaaaagaaaactcaaaaggtgccattaaaaagcaataccattttcaggcaacattattgcaacaacctttgtgagagaggacactagcttttcaggatatttgaaaaataatataactaacatgctattttatcttaaacagctgtgttcctgtaaaagtgttttggattagaaggtatttttaccttcatactggagtatgaactccccctgctgttcattagagtatttgcaaagattacaaaagacatcaggttaggatgtcattgtccccaaaatgaaaatatttgtatgtatttcaataagaactaaatgcagtaagcgctaattcctcattcaatattcactatattaggaaatgtaaatcatttcaaagagaacaggtagtcaggaagatgaaaattttactttaaagcaaggatttaaacaaagaaaaccataaaaacaaagtccattttatctgttttattaaagaggaagaaaaaataatattgttactttaaaactgtgattgtcaatatatataatcaggggtcttccagataatcctaaagttgatctctttgaataaaataaactccatttgtccaaaatagttaagaaagactctattgtggttacttgaaaaattcagctaaccctcttatgaaatgtgtgcaacacctattaattttgaaatgtgggatagaatacctactaaagctatatttaaggtattgtaaaatgtcattaattcagaaaagattagtatcatcctacctataagaattaaattagcaaatcaaaattatagaatgttatgaaaaatacattttattcataaattaattagattttacagcatatatgcatgcatatatatatatacacacacacacacacacacccatatatatgagagagaggaaattaggttcaacatgacctaatattagagaacatattggaaggtcactgtttgttaggataaataaatactggataacctcgttagaaaggtggaaagaggagaacgtagcaatctggctattttggacaaagggaaggttattatattcatgtttataacatgaaaatggccttatttttgtttctgacatgagacaataatgagttaaatattttattggaatttcatcaaaaccttatttttactgttccttctaaaaatttgggaggggaatatagtagtaacttctctattgacacttttacctcaccgagggggtaaaagatgtagaactgctgttccctagaatgaaggtctgttgtttggtttttaaaaaaagaagagcagaaaaagtttgacacagtattatatgattttgctggactatttcactagaaaccacgtagaataggactaactgatctcttttgaaaggggctgatttgcttattcatcaataactaatccaatatgtggacagtaatcttaatttcaaagccttttttgaggatactacggtgtagcttaagtgaatttaaaaagagtgcataaaagcttgtttttaattacttataacaaagcacaaattacttctaacaaggcaaatatttattgacatataagacattctgctaggcattgtaaaaaaaaaaaaaaaagtaatggcttttgtatacataggtacttaagacagacatccaaaagaaggaaaaaatgcttaatgagtgaagatagcactgaaacatgttgacttttactctaggtttgtttttagatggggttagtattttcccctacgtaatgtacatgtctttaggccacagtattaggagtttgatttttccctgccccaccctcaggtaggtggcagtggtcattgtagcttaatcagacccctgttaagttcctgggcatttcaaggtaaattcacgtcttccttctcacagaaattgaatagacctctcacacacttatttacctcccccaacaacctgtatccttggccctttctgattttctctgcttggtctctttctactcttgacagctattcttacctacttcccactaaacatgcccaattttttaattaaaaaaaaaagaattcctatatttccttccctattagaatcaaagtgtcactcactcagagtgtgaacatcctgatttacaccaaatccactggtcaaagaaatgaataaagggaaaaggaaaaatgtggaaggcatgcaggaaaaaaaaaaaaaaaaaagcccttttctgtaaaaatgtccatgcctacacttgctttagaccatcccatatcctcctgcctccatctcgagtctttgttcacattccacaccacaagacagtgagggaggactgtacttttcagtaccatacagaagggagagcctgttctaaagctgacgtgggtctcaatagtacatgagaagcacaattcccaaatgatctgggatctcctgtttataaatatattaccaaattcaagtgtgggttcttcttctatttccactgtaagattgagggtgttgaaaaaacagtagtccttgagcaaatctgtgaggaatcttgtcagaatgtgatctttcctgggactagtttagttgtgagaactacatctgcttgttctgggaataagggtctccccaggtcctgccctcaggtggccctggctgcaggacaggatttcaggtatcagaaactggtgtgtgagccaagcaaatagttatccatttataaaaaggatggtttgcagtgtgttataataattttatatctagcagggacaatgaaaaatggttatgtctacattattaaatgaatgaaactaatgctaaacagttaattttgcatttttatttttctgtgtttctaccaagtcagatcttaaaaatgggcagtatatgaagagctttagtttgtgggagtcatgttttcagtgatcaaaaatctctatattatttagaatataattgtcagtcttgttgtgttttgtagatttattgtttttaagccatagtttctagattacctacttttaaccctcaagtaaacttttccctatttttcagaaatctgtttgtgtttatttttagaaagtaaacatttagattccttttctggtactttttttctccatttctatcacacagatttgaagagatcagtatctatcattgtaaaatataactttattaaaatttgcaatctgtctttctataaattattattccctaaatgtgtattttatgttaatttaactacctgaatatttattttgtttaaataaggaggcagctgtctaagaatttttgttaatattactttgtaaattgcgtaatgtaatttattttacattatgtacatttcctttttaacgcacaaaatgtctatgtacaattaactacagatttgcaaataatgtcactaagctttattcagtcaatacagatggcatgtgaagatgtaatatgcttttttacattttcatatgggttatttgtaaataactatattgctgacaaacataaatacggaaatcattttcattctaatcatgtgtatctgtgttttgatttgcaccaattgcttcttaaatatggattaaaatttttttccagtgaatacctaaatccttttacctactgtattgccctttcctgggttgtataacaactccaatttagaaagttcaagaaatgcaaacttttactttgaaagttggctgaggccaccaggtgaatcatggacaagggacctcctggtttccagtcaattcaaaaatggcagcagcagaggatggggaaactctctacaacagagtacagcttttcccacccaatcagtcataaggcacatccctcactgtctcttgtccctgtgtctacccacaaaaaaccaaacctaaaagtcaaagcagaaacttatgccttaacaaattcaggaagggacacacaacttaagacaagttacttccggggtagtttgcagttaaaacattttctgaaatagctatttgctaaaatgtaagtaagtagggaaccatttaagccctcaatctgtgaaccactcagaacatgtagctagcctacatgcttgatgaaaaaatggtaatttccagtctttttcttttctgtattactcattacaagtgaaactaggtgaaaaaaattttcaatgtatcacacagatttttttctagaaatctggactttcatagtcaaatagctaacttcatttattattttgcaattccaatttatgccctacaaacaaaaatatgaatattactggtctacattttatttttgctacttctgtgtccctagtgattctttcattaaagtctgtatatattccacaacacacttcaatttatacctcccatcagtgtcagttactctgaaaagatattgtacatacacaaaaatgcataaatgtagtcagggtttctggtattgcagtacttttatgtgacttcccctccccctttcatcttcttccatagcatctcccagccaagttaactcaagttaacaatctgatatgtatcctgtcatatttttctccctgatcatatgacattataaatatgatagtggggagtgagatggaacagagagagtgagagagagaggaagagagaaatgggtgaatttagtagatacaattaggaaacagcttcattttttttttcctattactgttttcaaacattatcaaatgtccttcatcctgtctttggtaacacctaaggcaaatcccatagctttttgataacaataagagttatcaaagtatcagagttatcaaagttccaatccaggctaatcaaaacatcaatccctctcattgctttcatctccttgactagtagcaaatttgagcagcttttcatcttttcatatacgtctggatatttggacttgaccttctatagcatataattttcaaatggcaattctgatgatgccaatatgttgttaattttaggccatcaactaatttttattttattattttttgagacagtctcattctgttgcccaggctggaatacagtcgtgcaatctcggctcactgcaactctgcctcccgggtccaagcgattctcctgcctcaccctcccaagtagctgggactataggcatgtgccaccacgcctggctaatattttgtatttttagtagagaggaggtttcactggtgttagccaggatattctccatctcctgacctcatgatctgcccaccttggccaggcatgacccacttcacctggccctaaattttaacgttttttgtaaagaaggaaaaataaattttgggattctatttccccacaatcttttttgttgtcatctcaggcagaggttcccccaccatgtggccacctcactgtccccctgcctgttgtgaggctggatattctctctctatcctagctagcccctatgcatgctcattcccactcatgctcacccttgagcacagtgttactggaagtgatgaagctggagcccaaccttctattaagctatacattctcttcagagctttgacattttttcctacctctacctagaaacttccccttgatataggcatggctgctccccgacttcatgcaggtctctgctcaaatggcccccctctgagacgccttccttgactatcccatcactctctattctcctacccttcttttgttttcttcatggcacctgacattacatatcttcctgtcgtttgtttttttctctctcccacacaatgagagaggccaggtctttgttttgttcctcgcatggaataatatccaacacatagtaagaattatgatttctttttgggtgaataaattaacaaaagaattagtgaagtacaagttttatgactaaagagtagataataataaatagtggattaattatgaagaggccactagagttaaaaaaccaactaactcatccatagcttaaagctgtcagtactctactctcataaatatatcttatattcatttcacttgccagatatatgttactctaaacacttagaatgcacaatgctgacaagaacagaacagtaacagagcagttgaagaaagaaaaacagtaactgagactggcatcatagaggagtgatactaaatagctaaggatactccagtaagatgtgggctatgggatttacaaaactatattgaaaacaaggtctgcaaaatacataattctatcgtagctttcactcaattgtaatttaagtgaatcaacttaaattaataggaaattgttccaggggaagtaggcaagagagcttggaatactggaaaattaagcaaaggacaatttcaaattcctaaaaagcctttgatccaggatataaaagcagtctgattatacttttcagtcttaaataaaattgattttgtgatatcagtaataatcaaattatatactctttgcttcagagcagaaataaaatggaaaaaacagaatagagtaacaattcaaagtgcttccaaattcccataatttgctttgaaacaatagaggaggacattcagcaaccatgtaaatactttaatagaccatttaaaatccattccttttcaaaaacaatgtcttgatttccttgagaagtaaaaagaatttcaaaatcagaatcagccagaaagtactacagagggaaagccagcatcttagtggatagcgtggacctgtgtcccagtcttttataaacacagtgagtttagcgagaatcctgtcacaccacatccctagtcaccctccagcggctatgctgacagctgaagtataactgtaccctttcacaatttatctttataaaaggttcacgtgtttacaatatttgtctgctggcagggggttattcttaatgtttatcactttgtacaatttgtttgccaaagggtataggtcttttcttctgatggcactaccttggtatctatggggaaaaaaatgctttataaaataagtcgagtagaaaagtatcctggctgtagaaggaggtatagtggaaaggattataatcagagacttatataaatgacccttaaaaattaatgttggtatgcttatgaattctaatctttatacggaataatccataggaaaatcaaattaaaatgtctcctacaatgatagactgaggctatgtctggtagtgatcatgatataaatgcatgttacaaaaacattacggcaacatttgttcagtgataaaaactaaagaggcctttgatacaattctcttcagaataggcatcatattggctttcagaaatcaacaactcctagccagaaagatttaaatgtaattatgggtttataatgaaagcagatgtaggatgtagcaataaattggtacattatcttacttagatgataatgccaagtgtagagacagtccattcgtatggaagtattaagagcaatacctaccactgacaatggtcagatcctgcatattttacaaagtttaagaaaaggaaaccaagaaaagacgaaatacctgtattgaaagttttgtcaggatatgggaagagggcccaaagaacaaagaagaaaatataataagtagcttttgaacttaccaaaaagattctcatgagcatttatcattaaagaaatgttatttaaaacaatgacgcaatagatggggaaaatgaaatttgacaatccactatccgatcaagtatataagaaaaacaaaagtatcgttcttttctatttctagtagaggtagtattaattatcaagtcaataaagggccatgtaaatagtatttttaattataaataaacatatcctttaacctagtaattccacttctaaaaactgaccccaatgtctagaaatagatgattgacagataatgatttgtgtattatatatacatgtgttcatgtgtgaatagagaagtgacagatatataatataaaacatgcacaataatataatacaaggttatgtgttgtatcatgttggtattcactaaagtatggaaacaacataagtagacagaaacactgctcactgtgttttgtggatgaaaagtttaaataacacaagatcttgtctataagatcttatttctgtctttaatttgtcagaattggggactggtaaaattattaagaaatctcagcacatatacatattcacaaaatatttcttagttatctttttgaaatggccctcaagctgtttatttttaatgcctcaaactatttttttttttttttgagacagggtctcacatgtgcccagtgcaatggcaaaataagctcactacagccttgacctcctaggttcaagcaatcctcctacctcagcctcccaagtaactggaactgtaaacacacgccaccaaacctggttaattttttgttgttgttattggaagagacagggtcttgctatgttgccaagactggtgttgaactcctgggctcaagctatccacccaccttggtcccccaaagttctgggattacaggcatgagcaaccgcacccagcctgatacaaaatattgattggaagttgagactcaagatctttgatgtagtataaaactcaaaaatgtttactcctaatcatgcatttataaagccaatttaaaaagcaatcataagtgagggtccttctgtataaataaaagtaaaaatgatgctaaatatttgtcattttggaatggacctttttttctgcctaagtccctatcttccaaaataattttaattttttaaccctctggctcattgttgctaatgtgaaactgtacttcagatgtgccaaaggaataacgaaaaggaattatcttacattttagcaattgcctgaagttaaatttaatgaactgaaaaaaatgtttctgcaacattagcgagaacagcttaaaaaaaaaaaaaaggcccttttctgtctgtagtggtcagtgcttaccaaataatgagcaaaacttttgcagctcatgtggacttagaaaaccataaaacatcaacttggaagttcagagaactgattgtctttctgattagatatccagcctcaatttttgaggctaacaagtaggtagatggaaaatgtacatcaaagacctctgggggaaaaaatggaacaaatgcttgcctaattggattactgctatatatctcccaaaacatcctgttagaacctggctatgaagaacaagaacaacaaacacatgagaagcttttgtctttcatccagggatagttggaggaagttgaaaaatatgggaaacttaatatcaatggtcaatccaaggacaggtgtaatgagaatattatttaccacaagaaaagattcagttctaacattcctcaattgcttcactaatgtgataactgctggcaaactatatttatcctatagtatagaaggaattgcagacaattaaagctgagagtctgagaaaaccatcttctctcaaacaaatgagaagatgtagtgtaagtattcactgaatacaggcagtggcatgtggtgtgcatctctacccattcattcatttcataataattactgagaatctattacgtgccagacaccatcctaggctttgaaggcatagttgaaaagaaacatgacaaaacttgtgtttatggagcatacattctaatgaggggaaagagacaataaagaaacaaggaactacaatatactggttggtgggaaaatgccattgagaaaaattaagtagggtaaaaatgataagaagtactagaacatggaagccagccccctgatctgggcgcattaagagggggaaatgtaaaggatgtaacaattgagagaaacaggggtcccaggcagttagcctgtgtgcaaagtccctgaaaggagatcatgatttgctcattatagagttatacaacaaatcctatgtggatgagaaaattctgcctaagaataatagtgggttgctcaacagggaaacattctccatcatctccttagatattatgcaatacgttgatgcttcagttagaaacttcatggaaaaaaagaaagattagactgagaaaactgagattccagagtcagaaccaccccaactttctattaccataatgaaacatctctgcatctcttctaaatatatcaaaatgttcttagtatgtttgggaaaatgctgtaaatgttaaaagaaaaaaatggtatctatcctcttagaaatcaaaggcaataaagacttcgagaaatatttttaattatagtattcaggtttgttaataaggaaaagatattgacttacaagaaatttagcaatatatatcgatcttaaaatgttaatgccctttgaccatgtaattccactttagcaatcctaattattcaatattgataaacttttatgcacttcattgcaacatcacagatattggttgaaaatatatgttcaatcgtacacatgaaaaaattcatacttaagagaaatctatgaatttaaggtatatgggaaagtatgcaatcttcccagttctttctgaaaatatgaaagaattcatactggagggaaaaccctatgagtgtaaaaaaatggggtaatagcctcagtgtttttagttctagttgaatacatcaaagaatttatttctgagaataaaatctataaatgtacaaaatgtggtaatgcatccatttctctcaaatacactaaaagacatgacaatgcccactgaaggtgggtctcaaatacaagaatgtacccttggttgaaaaccgagtagtttgcaaaacataggaaagttttaattttaatgattatttttaaagtcatacggaaacatccattggaaagaaacctcgtaaatgtaagtgatttggaaagctgatgcaaattaaatattgcataatgctcaaaaaatgcacatggatgaaatgttatgtaagttataaaaatattgtgcttatcagtgactcattcttagagagggtctctagtctatagatttctacttcttttgcaaggaaacaggtaagaattccatattctttaagcaacagtacatacatttaataggtagttttttgttcttaagtcagttaataaaatttttttttcatttatctaaaaaggtgttggatccatgggtgaactgaaatcaatttctaacatataggtaaggtggattttatataactttttcattgttctgtgattaaatgagtattgattgttgggattttcttactacgtgtatatagcaagttttggttatccctcatccattatatatgctccacattttttattagaaaaactattcttcttcgtcacaaagaattttattctatattctttcctaatagaattagtatcaaattataaatatgtaaagtttagtgtatagtctcagatgaattattatcatttcttgtactttatcctttgtgactatttctgcctgttatttggatagttcactttgaattaaaaagagaactgtgaaatgtgtgtgtgtgttcaatcttaggggatgttagaggaaatatgttacattcatattgaacactgaaaattctaaattctatgctgattttcagttttatgttagtgaagaattttgacatggaaaaagtttataatgttcactgaaaagaagcaggatacaaaacattgcacatggtaaaaatatacttcagcatggccccatgccataatgcaatgtaaatgggaacttggaaagagaaggcctgggttccagctcgtgctcatcacttaccagcttgatgtctgagagcaagtcactgagcctccctacactttggttttctcttctatataagggaagagaacaccaccacttctgccttccttataaaatgataaatacaaacaaaataatatgaatacatttaacatgttttataaatgctgttatgattggtgtaatcttcctttaaacatttttagagagttttaatattataccatagagtttgaacttaaggcattttaagctgaaaattacatagaaaaatcactctggcagccatcagggcaaggttggaaactaattagaagactactgcattggtccagaaaaaataaaatgagagcgaagaaaaaggaaggagtaatagatattagagtaggatttcagcaagatatgttaatgagtttgaattggtagcacttgataaccttttggatgaagagaatgataaaaaggtaattcccaggtaccagcttaattatccatttactaagactgagagtgtagaataaagattgcatttgggagcaatttttaagtttcaggtgactgtaggacatccaagtggacctacgcaaggaggatactatacactggagtctaaactcaatagaaggccgggcgcggtggctcacacctgtaatcccaacacaataggaggccaaggcaggcagatcatttgaggtcaggagttcaagacgagcctgaccaacatggtgaaaccctgactctactaaaaatacaaaaaaatgagccaggcacggtggtgaccacctgtaatcccagctactcaggaggctgaggcacgagaatcgcttgaacccaggaggcggaggttgcagtgagccgagtctgcacaactgcactccagcctgggtgaaagcgtgggaccctgcctcaaaaaaataataaaaaacataaaattaatagagaagttcaaaattatagattcagaatttgtaagtcgtcagctctcagctaaataagattagtcagagtgctgtgtagacagacaagcctgagaaacaccaatatttaatggatgaaaatacagagatgaatctgcaaaggataacattaatgtagaaatgaaagagaacaaggagagagtgatataaaggccaaggataagaaaagaacttgtcaaaatattgtagagaaggcaaaataagatgaagactagaatttgttatatttggcacttgggtcattgttgacttttgccagagctggctgagtggagtggtgggtacagaagtttgtggaagggcaagttgtaggtcaggaagtgaagacattttataaatagtccttttgagagtgttggctagtgggacagacagaacgtctccctaaataaatgaaaaacatgagagagcaataaaaatatatgtgatttaatatagaaggtaaaaagagacagttgtcattaaagatacaattatttaagtttactccattaactgaactaagagcttagcatgcatcattgtctcattttcacaatgcttcaatgaggtaacacaatacaatattgtaaaatgataatattgagacttggatgacaaagcagacatgcctgtcagcctccagggcctgtcctcttaaccactggactgtgccaattataagtttattgagctgaagcctgcagcctaaaagtgttaaatgagtctcagtttctcttctagaactacagagaatattcatatctttttccttattacaggttgagcatcccaaatctgaaaacctgaaatttggaatgttcaaaaatccaagattttttgagtgtctatgtgatgcttaaagcaaatgcatattgggacatttcaaattcggtatgctcaactagtaattatataatatcaatattccaaaatttaaaaaaatccagaatccaaaacatttctagtcccagacatttcagataagggatactcaatctttattcatctttaagtgtttaaattaaagttcctatgatatcccacacctccttttcaagcaaaatatccctgattccatcatagttcttcagataactttgatttctatctaagcttgcttttaatacacaaagatttgaggttcacagacttcttataattccagtcatcccactgcagacattctccattgtatcactcttcttcggataaaatgcccagaactaaaaatgacacactagatgaagtcaaaccatccttgtcctagacacgaaataccaataaaagcacactaagattatattcacactttgtggtacaaaatcttctttcaaacaactaagactcctaaattttcctattctcatgaaggaaagttataaattcttttcaatattacattctattactaccatattacagagttcattatttttcactgatataccatcatttgcatttatctattacatgactttagttttattttccagtctctgacttttaagaaattttggagacttgtctataatccagtgtattgtctccatctttgtgccctttgtggatttaatgagcatctttctgtctccatccaatacatccatactatttgaaagtataaaacagatcctgaatacctctcagagactgtcattcattcagtaaatatttattaagaaaagccttctaggccaggcacagtggctcatgcctgtaatcccagcactttgggaggccgaggcgggaggatcacttgaggccagaagtttgagaccagcctggacaacatagtgagacctcatttctacaaaaaagaaaaaaaaaagaggcttctagggtattggtaattttctgtttcattactggtgcttaaatatgaggttcacattaggataatgcattgagctaaatatgtataatttgtgcaacagaacagaatagagttcaaaaatccaggtacatttagtttataataaaggtgttaattgaaataagtaaggaaaagtgtaattatttaataagtagtagtatagatacaactaataatcatctggaggaaaaaaccctgaataaatttctaaattatactttaagttctggggtacacgtgcagaacatgcaggtttgttacataggtatacacatgccatgatggtttgctgcacccatcatctacattaggtatttctcctactgctatccctccccaagcccaccaccccctgacaggtcccagtgtgtgatgttccccttcctgtatccatgtgctctcattgttcagctcgcacttatgagtgagaacacacagtatttgcttttctgttcttgtgttagtttgctgagaatgatagttgccagcttcatccatgtccctgcaaaggacatgaactcatccttttttatggctgcatagtattccaaggtgtatatgtgccacaatttctttatccagtctattgttgatgggcatttgaaaaccctgaataattttaaggtttatttttacagttttattttagtgtttatttgtcccttatcagcttgtggtttctagtctgcaaatggcagaaatttttgcctctaacattgcaatgttgcaacatagttttgcttattctgatgtaaacaagtatttcaatgacattgtcatttgcttattttttgtttcccttactgattaatttgaaagcacacatttcctcatacttaaaaaaacttttctaaaaaaagaaatgttatagtcaaataaattgattcctagcagaaatgttaattcaaaaatctggctttacaaccacagagggtacattcctttactcatggagtcattaacagatatttattgtgtatatagtatatgccaggccatgtgctagactctggagataccagcaatgaaaaatcatgatcccttttttaaaagaatttttattcctgtaggtttttgagtaacaggtggactttggttacataagttctttattggcaatttgtgagattttggtgaacccatcacccgagcagtatacactgaacccagtttgtagtcttttatcccttaaccctcctctcaccctttcacctgcgtccccaaggtgggagctaagttatgcagatgcaaaggcgtaagaatgatacaatggacttaggacctcacgatccctctcttaatgggacccaagatccattgagaactttgtcagaagaatgatcacttgagacagaataaaagaatcgttctctgattaaatgttgacaatgttaaaaataaagaaaattgatgaaatattcattttttgtaaaatcaattgggaatatcaaaagagttataaacttaaaatgtgtttttggttcaagaagatagtgggaaaagtaataaactttataaaaagcattaatttattaagttaaataaactaaaattgatatttgattgatattttcccaaagtgaagaaaataccacgacgtctttcatgtaccgatcaggttacctgtttctacaacctgagaaaataaaagtagtcttcttccttgggttgtttcccaagaactccaaccactcctcacctttagtcaggactgctccgaaggatgccccagcacatgccagcaatcccaaagcaagcagaataaggaagtaagacttcaacccctcaccccattccagacacccaaacagattctatagaagagaagattatgacatttcacacattaattagatcacttcaatttcatggagttatttcagagcgtctgctaggttctgtgtagctgtaaaacaaccttaaaaggcttatggcatgccagaccaaaaggaatggatagcggggacgggtaggggaagaccacagtgaaaagcataagctatctgatgcaccactctccctgggtgctcaaaatgtcaaaaaggctcatgtatagtcttggggagacctccaagagaatagatttagcatgcccatatactcagatgtcatcatggtacagaaacaactaggaagaaaatagatgatcttaaatactgaatttttttatcccagaaaaagtgaacaatgcttaaggaacaattaaaattattagatcagattatatttgaaatcagatagtataaaaagttaatttttctcagaagtgagatgagctgtaagcaaaataaaaataatgaggatttaaaatttgttgaagtttaaaatttataaatctgttagaatttgttacatcaacacactgaaataaaagccagtcttcactgaccagtgggagtgtttcctatatttacatattaagatccagttcccttgaggctttgattggcagacttaaaattaaaccatagtagtcaattgtaaaaggcttctctttgtgaaattttctcataaaagtgtacttgttaagaacaaggagtctgtgacctcactccctggattaaatgttgagttctgccacttacaagctgtgtaaacttggggaaattaatctttgtgtttccattttcttggttttaaaatctggataaaattaatatcttttcttttgcaaagtctttctactcctgctatatcctacccttttaaggtgggcagaatatgtgactgcttgatcaatggcatatggtagaaaggattctgtgtttaggagactgatagcttccactttaaccctctgagagcatttattcttggaatccagccaccatgctgtaaggtctcaagtagctccatggaggcgccatatggaaaagcaccaagcctccaatcacagacagtggctgagctaccagccaatagccaatactaacggaacggacaagatgagtgagttgtcttaaaagttgagacaccttacctgtcttcacttcaaacagagatgagctgaccccaccaaactatgcctatatcacaggtttgtgagccaaataaactattgttgttttaagccacagaggtgtatacagtttgctattcagcaatagagaaccaaaacaaaatttgatacctagaatttacaaatgcctaaaacatgtgacactaactttgtcaccaggcagcaggtggaagctcacagggtcttgggagatttgctcatgaaagctaaagtggacttttcctaacttcagataattgtggacgttggaagtcatgttaggaccataatttacccccaagtttttgaaacatagaagctccaagtaaaaatagtttaaggaagaggaaaagagatcaattacactagaatataatcagctgctttgggtccagtttaaagggttataaaatgggatctgtcaagaaagtcttaaagttctagagattaattaacattgaaatagaagtggctgagatttgccaaataactctaaatcacccagagtttttctcctctgacaggacaataaaactcgtgcttaaatagcagcaggaatgcgacaggataaatttaaaacacacttggcaatagacttaa

SEQ ID NO: 1776 - DNA, 533388 bp, Homo sapiens
  CACNA2D1 gene - 81224069 - 81717456 of chr7; NCBI Entrez Gene ID: 781; Build 35; sequence includes 20,000 bases upstream of initiation codon and 20,000 bases downstream of termination codon of the gene
cgtaccctgtggagtgttcttttgtttaaataaatctgtgctttcattgttttattctgtcattgctttgtttgtgcattttgtccaattccttgttcaaaatgccaagaacctggacaactcctagtaagacccccacccaacccccactggtaacactagggcctttttttttcccccccctttttttttctttttgagacagagtctcgctctgtcgcccaggctggagtgcagtggcgtgatcttagctcatggcaagctccacctcctgggttcagcccattctcctgcctcagcctctggagtagctgggattgcaggcgcccgccactacgcctggctaattttttttgtatttttagtagagacctggtttcaccctgttagccaggatggtctcgatttcctaacctcgtaatccgcccaccttggcctcccaaagtgatgggattacaggtgtgagccactgcgccaggccaacactagggctcttaaaattatgtcttagcccttttcatgaaaggtctataactttaatccttgtacaccccagcatggtgaaactcttgaaaactttgctatgcttttcagaaactttcttcataacctgttaaactgaccatgtgtccggtacaattctccaagtctctcttctctcaggatctttgtaccaccgtttctttattttgcttttttcttttacttcagccttgcaagaccactgaaatctctccagatatctctttcctccagcggtgatctttttgcccaggcaaagccatattctcagacctttgcttaggaatgttagtgcacttctttatagttctttctccaaacctctggaccctttaccctgattgatttaacagaactttgatgccttttaatatttatgtaacttttctagttgttctcaaaataaacttcggtctgctgcaagctaactcattcgatcataataaaaaatctgcttcagcttcacatttttctttctttcttttttctttttcttttttttctcttttttctttttctttttctttctttcttttttttgagatggaatctcactctgtcacccagcctggagtgcagtggcgcgatctcggctcactgcaagctccgcctctaggtttcacgccatgctcctgcctcagcctcccgagtagctgggactacaggcacccgccaccacacctggatttttttttttttttgtatttttagtagacacggggtttcaccatgttagccaggatggtctccatctcctgacctcgtgatccacccacctcagcctcccaaagtgctgggattacaggcatgtgccacagttttttcttttattggaatgttttttaccgcactcttcacctcgctgtttttcctcttctggatatcttcattcaggaaactatttactaattcttcaatcaatattaagttttgctgtttaactgtttcctagtaccttatacttttcatctatagcacttctcaatttctgtacttaattgggttatttgcttaatccttttcctcaaccaaatcttaaagtccttgaagatagggaacattgtactaggtgtacatgtgcgtgtgcatgtgtgtgcttgtgtgtgtgtgctatttcctagggtctgttgcagatcttggtaaatggtaggtttgtgatcctgacctttatcttggtcacgtattcaagcattcagttctctaactaatcaacattttgtgcttgatactccacctgccaggaggtagcgtcttacctcaaaagcactggtttcctatcttggttgaggatatagttctagtaagcaaatcctttataagtaagaaaaatttaaaaacattatttcccgtatatgataagtatgtattagcagcaaagacagctaactgttgaacaacagaagtgtagctctcttcccatagtatagaattgactttggcaaacccatgcaaacagacagcgccatgtgactacttcctccattgaaatgtgagcaaaaattctgtgagttgcttttatgcaaagtcacttacaaagaaggcatttcttctcttctctgccctcttctgcagatcactctgagattcagggaacttagggccacaggattgatggaatcttttttccatgagcagtgacttctgggttaaggtttcgataatattttgtctatttttggatttcccctttgctgagggcatacagtatagggcttttattttattttattttattttattttttgagacagtctcattatattgtccgtgtttcagtgcagtggcacgatctcggctcactgcaatctctgcctcctgggttcatgtgattcttgtgcctcagtctcccaagtagctgggactacaggcacatgacaccaagcctggctaatctttgtatttttagaaaagacagtgttctgccatgttggccaaactggtcttgaactcctggtctcaagtgatcaaccctcctcaaattgctgggattacaggcgtgagccgctacagtcggccactctagggttcttaaatgtatgtctttcatgaaagttccagaactctactccttgtccctgcagcatggagaaactattgaaaactttgctatgcttttagcataacaaacatctggatgaatctccacatcgtactattcatagagtgagaagtaaatgcccatttcgttgagccgttgaaacacatcggtttatttgtaacaacagttaacattctcaaactcatacagaaattaattctttgaactgactgctaccagaacaaaaacctaaagcatgtggtactggttcaatggttaggagactgtctgcaaataaattgatgtaacagactagaaagttagggatgcatgttatggagtgtcaaaacatttggtcaaattgtcaccagcagaacttaataagccaactacatcactaccaaacctataactctgtataaagaaagagatatttaaaaaaatctataatgaagatgctgtgagttgcttcattcttgtttgacttaatgaagtgttacaagagaagggctcatgtaagaatgggatgaaaagttcaggcctatgataaacatcagtttaagagggtttcattcccaaataagcttatactttcagatggttctaaagcagctaatattaaagagagagagagagaggatcgcaagaaaaaaaatcctgaagacaagttgagtattacgtctaggaaaaaacttttgagtatagttattgtaagttggtactgacaaaagtaattagaagcctctaaatcaagcctgtttaacctatggcctgtgggctgcatgtggctcaggacggctttgaatgcagcctaacacaaatgaataaactttttaaaaacattatgagtttttttgcgattttttgttttagctcatcagctattgttactgttactgtattttatctgtggcccaagaagacaattcttcttcttccaatgtggcccagggaagccaaaagattggacatccctgctttaaattttaagataatcctattgttaagaactaaacaaaacatgagtctggccttaaaaaaaagactacaactttatatatatatatacacacacgcacacacacacacacacacacacacacacacacacatatatatgtctctatccccacaaatttgcaataatagagattataatccaaaaatctgtgtagcttccaaggaggttgcattagtttcctattgctgctgctattataaatcactgaaagtatagtgacttaaaacaactcaaatgtattatcttttagttccagaggtcagaaatccaaaataggtctcactgagctaaaatcaaaatgtcagcagggctgcataccttctggaggctctaggagagaatctgtttccttgcttttcacagcatctagacaacattgcatttcttagcttgtgaccttttcatcttagaagccagagatggaggtccagtctttttcaagctgcatcattctacactgactttcctgcctctcttttccaccttctgattatatcaggcccccaccccagccagataatccagaataatattcccatctcaaggtcaggtagcaaccttaatttcatctacaatcctaattttcccttgctatattatgacacattcaccggtactaaggattcagatgtaaacttttatgaggggactactgttctgctcactagagtgggaatattcttcactgtgcactttagaagcagtcacggaggataacagacaaagacaaaactcccataaattggaaccagaggccatcaaaggtaatagataagaaagttaatctcagagagataagtcaaggctttgtagaacttcttcaaaattaagttttcgtcatcacatctgaacagcaaaattttgtcattgctgagaaacagtaaattttgtatttatataccattggttcttttgcaaatgagaattgtggcagcaatccttacactgtccaaattttatactgcaggtgtgtagtaaggggatgggcaggaaacttgttctttagctatcacaggaacatgcggggccctatgtgaatgaagtagagagaactgtgcattgtgtagagatcctggacatggagctggataaaatgatggtgatatggtttggctctatgtccccactcaaattataaatcatgtccaattataattaccattgttgggggaggggcttggtgggaggtgattggatcatgggggtagatttcccccttgctgttcttgagacagtgaatgagttctcacaagatctgttttgttttgttttttttgagacggagtctcactccatcacccaggctggagtgcagtggcacgatcttggctcactgcaacccccacctcccgggttcaagcaattcttctgcctcagcctcccgagtagctgggactacaggcgcacaacacgatgcctggctaattttttgtatgttagtagagacagggtttcaccgtgttgcccaggctggtctcgaactcctaagctcagacaatcctcctgcctcggcctcccaaagtgctgggattgtatagcactttggtaagatgtgcttgcttccccttcaccttccaccatgattgtaagtttcatgagccttctcagccatgcttcctgtataccctgtggaactgcaagtcaattagaccttttttctttataaattaccctgtcttgggtagttctttatagcaatgtgagaatggactaacataatacagatgggataggaacttagcttagaaggaagaagaatgttctacgtgtgggaagaaagaagcaccaacatttggttgtcagaggatagtctgtggcagagtcgtcaaatttatgggaagttactgcctaggcaggaacttcatttgtcaacctctatttgcatctaggtgaggctatatgactgagtagtttacctctagagaatgagagtagaagtgacaggtttcaagccattaagaagttagggatggcattgggagatgtacctagtgtggatgacgagctgatgggtgcagtgcaccggtgtggcacatgtatacatatgtaggaagcctgcatgttgtgcacatgtaccctaaaacttaaagtataataataacaatttaaaaagtggatattccttgtccagtcccccattctccttttatctggatgcaaagaacgttaaggccctagagacagaggagccagaaggaggaaagagcctgggtccttgaattaccactaggagaaatctgcctgctgtcaagcaagcctgcattggactacattatagtaagcaaaacctattttttttttctgtgttaaaccattcatgtttaagggtttatttgtcaaataagtcaatgctaacctaataaagaattacttatataatcagaagaaaaatctcaatcttaaaaaaaaattttaatactgtagaatgtgttcatttttcccctattaagataccaaaatttataaaaaccatagcgttaatgcttataattcattctgagactatattaatcagtgctaaaatttgtagttatttaggtacagaaacattatttgcctattttgttcagcagtttgttgaatattcctttaaaggtaagtactaggtaaaatacattgttagatataatttagcatgatcctcaatccatttttatttttaagggtcttggttacattaaagcatgtgtgaatttaatctcgtcaaattacctccaagaatggaactatttttgtattaatgagaaaaaatgtaaaaacatatgactgtttgcaacagttttatataagagtggtataattagaaccaaattctatgggtgataacacttgaaaatattgagcatatgatgacaagaattaacctatttcattttataaattattactaaagtaggtatgtatttcagaggcttgatttccttaacagtatcaaggtagtttaataatgttgattatactttaatttaaacccaataattggcttgccagttcacataatctgattctgaaagttaacagagaattatctaatatttacagtcatgatgcaatgtttcttgtaaagtaaaatattgcatatatgtggctttggaaatggttttcaaaagtcattacgtttacaaaattctaattggaaatcacaaatgttacagtaacccaattcatgtatttaccagtggcagtgtttgcactagtgctcctatccgtttatgcatattagttgacataacagaaatacagaattaaagcatctgtctccagatgatacagatttccttgggaaatttagagagttaaaagaagaagaagggctaagcgcagtggctcatgcctgtaatcccagcactctgggagtctgaggctggtggatctcttgagctaaggagtttgagactgcctgaacaaaatggcgaaacgctgtctctactaaaacaatactccaaaattagccaggcatggtgctgcgcacttgtagtcccagctacttgagggcctgaggccggaggatcccttgagcacaggaggttgaagctgcaatgaactgtgttcgtgacactgcactctaatctgggcaacacagggagaccctacggcaaaaaaaaaaaaaaaaaaagtaaaaaataaaaagaagaggaagactgaattacacttctacactttctgtattgaattatttttctttccataccacattttctttggagtacccagattacttttctgcccaaaaagccctaaaaccatttcctatttttaactaaaatagttttgcttattttttgcttttgttcccggaaaggattctgcaacccatatgaagctcagtcctactggaaattatcaaaatggatgaaattgtcttttaatatctcataaagtagccttggaaacatctaagactgtttttaaagtactcataatattttcttgctgattattttttcttgctaaatgatttgcgtggtaagttaaataaaatatcttaatcattccattttagagtgaaatatttgcattaaatcaaatctatactgattttcttacccaaaccaaaataacttttggcttaatagagcgtggaaatctccttcccaggtgataaactgatacttgataatggcaaatggatatttgtatttatgggagagatgcttctgcccagatggtttgtgcatttgaatgcacccaataaaataacgttggtaatagagtaacataatattcaacataataagattaccaacccaacataataacattgataatagagttttaaaccaagtggggaagaagatggccttgacggtacatgtcttgggaagaatgtggtctttgacaccctgattctaacactgaagagggacttccaactttgcttctcatgttgctggagctatttttggtatatgtcagcatcagtggcctttatacatgaaagtgagcagcagacctgacgggatttaactcagaaagtggtgttaacaggaacacctgatgctaaagctcacttcactgaatccccgttcccaccatgtgccaagatgatctgcagtgttagaagctttgctctgagtttgtttattgaattacaaatttgttttcagtgtattatttccttttatatatttttctccttttttctagctcacctcccatcatatcccattcgtaaacatttattttattaataacatacatatatgcaagtggttcttaaagtgtagtccgtttaccagcagaatcagtatcactttcaaatatatcagacatgtaaattcttgggccccacccagacctactgaatcagggattcagggttcgggcactagtcatctgtgttttcacaggtcttccaggtgtttatggtgcatgttcaagctggagaaccactaatatgtatgagtgggactgtagcttcaaagttacaactaaagccttttcctgtcatcttctaccagcagcactcagtccagcctctgtctcattttcctgggctgaatatgtcctttgaaacaatagaagaagacaagcccccatctctacaaatctacccctcccaggaatcaatcttggctcttagcagggtaattagaattcatttcagttatattgagtttaaacagatccaataccaaattttggttaatttttcttgtgtgtaatgcttctggcttgtttacttaccttttttctttcattatatatttattgtgtgcctactatggcccaggtacttgaataaaggcaacattgtctagatttgcagtctagtaattgcactatgcatttaaagtgtatgattcaatggcttttagtgtatttacaaagttatgcaaccatcaccactatcaatcttagaacatattattactcccaaaagaaaccccatacctattagcagttactccccatttcccctaacaccttactcccgtcctaggcaaacactcattgactttcttctctatggatttgcctaatttggatatttcatataaatagaattatacaatatgtgatctttcatgagtggcttctttcacttgacatgtttcgaaggtttattcatgttgtagcatgtatcagtaacttactcatttttattgacaaataatattctattgaatgaatacaccaattttattcatctgctcatcaactgatgaacatttggcctgtttctactattatgaatattgccactattaacatttcatgtacatgtttttgtgtaaacccgtgtttttctctttcctgggtcaatatcgaggagttcagttgctgagtcaaatgataactctacatttaagctattccaaagcagctatcccattttacattctcccaagcaatgtaacttacaagggttcttgacttggaattctagacacaagtttcaagtttaaaacatttttttaaatagcaaagggcatcacatcctaagactggaaaataagttgtctcatataacatttatatataatatacaaacacacaaatgtaacccaatttgtgggtagtaagtacaaatatatatatataactttatgaagcacatgattcctatcataatgtttggctcttagtaagttagcaacaaatgactatataattaatccaaagtgaataggtggctgactgaaagagtaaatgtataaatgaatgaataaagacatacaacgaaggcttggtatggtggctcacgcctataatcccagcactttgggataccaagatgggtggatcacttgaggccaggagttcaagaccagcctggccaacatggcagaaccctgtttctactaaaaatacaaaaattagctgagtatggtggcaggtaactgtaaaaccagctacttgagaggccgaggtgggagaattgcttgaacccgcgggaggcagaggttgcagtgagccaaaatcatgccacggcactccaacctgggcaatagagcaagattctgtctcaaaaaaaaaaaaaaaaaaaaaaggaagatacacaactaaatttctagtttgcatcaggcaatatgatgagttctttaggtttccgctatgcatttacaaatgtgctacatgtgtgaaacagacttggctttttttttctcagtgaaatacagtaaatcacccttatgctattaatgaaaataaatgaccgccagcccacatcaatcaagtgatatttccaaggttattaatttacatattatttgaagtccactagacaccatgactacaggtggtgattctagaaccagtgactgaaactaagtagaaatttaaatgcatgctcaggttcctaattaaaatctacatgagaaaatacatcatatgtctcaaaacacagatataaaaatagtcatttgaaacagatcttataagttgttgattgcctgtggattactgttactattgtagtttttaaaatttattttacttaaattttaaagaattctcttgagagaaagcacaaaaatcaggtagttgttttaatatctcattgagaaataaaatgacacattcttcacctatctgtatatgtgaggatctaatagaaaatgccacaatgaaatgtatttagttatagattttattgatttgattttcctggtatttccatatttagatttttaaagcttatttacttgattaaggtgacaatattttatttctataaaatgtttctgtttttctgatctacactgaaagggaaaaagagtcagtagatgaaggtgtcctactgaggtactgctgtttatggaagaacagtacacgaagcaataaatagctctagccagtgattaaatgtagaaacacagtcgatgtatcttatgaatacaaatgccatttacagcttcacatacttcaatgtcataaatactattttcattgcacaagtaaaaagatgacaacataaactccatatatatacataaatgataaaaatggcacaaataaaaacataggtacatgtgccaatctaaattataattttatgtttatatgaatctatcatgtgggatctaatgattagtatttttttcatgtaagtttaaatacaagtttttaaatagtgattacgtgctcaagatggacaatgtggagaagagagactaaggttttatatatggaaaaaccctgtcattaggaattagaaagacttaagggtcaaagtcattaaagtttgtctaacattaatgttaaattgaatttctatttggcacatgtctatatagccaatacatgtaggtctcatcaaatccaatcccagttcaaatatttaatggttgatcttttcaaataggagtgaaaatctttctataatattaaaaggcattagaatgtacactttaaatgggtgaattgatatataatatgttaattatatataaaaaacaataaagctgttaaaaagaacaaattaaaaaaactgtatcacagcattattcccatttaaaaaaaattaaaaactgaggctcaggaagactgagtaactctgcctaaatgtctgaactactaaatattcagagcagaaagaccatatggcacagaggttaacagtcaggctacccaaggaagtgtgcctgggctaacatcctaggtctgctctttgataaataccatagctaagagatatgcctgtgtctaacacaccactgtatgttaacatagttatccttagttacagaggagtttgtgtaatgattaattttaagagccaagagaaaatctgagatcagtaatttgagtatttgacacaagcctaatacatgaataagttcaagttttcttattaagaacaaactgatataagacatgggaaggagcccaagacagatgacacagtctggggatcctgaacatttttaaatgtgaacagtttttcaggtgagaacaaaatcattgaagcagctaagtcactgttgccctttcttgtaattccatttacactttcctattgtttatgaatttttctgaagaaggtatagggagacaaaagtgattctgaaagttgaaaattataaaaatgtaggttaaagttcacgagtaatgtatttaaaaaattgttatatacaaatcagcacttgatatgtaatagagtatgatgtttttcctagttcatataaatattctacatgtcaagtgatatagatttgcaactaacattgaacgcatagggaatttgcaaacttatgttacagtagttggatctatgtaatgctttaaatatcatttacttttttacttaaaaaagtgcttaaaggccaggcatggtgactcacacctgtaatcctagcactttgggggaccaaggcaggtggatcacttgaagcctggagtttgagaccagcctggccaacatggcaaaacccagtctctacagaacaaaccaaaaattagctgggcatagtggcgtatgcctgtagtctcagctactcgagaggttgaggcgaggggatggcttgagcacaggaggtcaaggctgcagtgagcgtaaatcatgccccctccccccgccacacatacaaaggaggtgtgttaaatattaacgtcatgtaacctgttttacttttaaattagaacaaaaacgttgaatgattatttatatttcttgtaaaatcatgagatttgaagattatgtatttgcttagcaataaaaatttcagttgattgaatactgaagtaaattgagttgccctactcttttgtctcatttatgcttccagtttctttcaagcaattttggccttgacatttccatctctggtttctttcttctttgcattgtgtttgtctgtgttatatgaacaaagtcatcctttgtttcatattgttccctccttcatgtttccatttttctctcctctagataatttctctttgctttccctacttttctacttccttttctctttactacttaaaaaaaaaaaaccaaaaaaaagaagtctcttctatggtaatatgttaaagacaatcaactattgcctgttgaagaagaaaaagataaaaagaaggggtggagaaggggtggagtgagttggctggttaactgggaagaaaaggagaaacagcagaactgggttctgttcctgaacattgatgtcaaggctttaattgaggtgtggatatggtgttgtaactaggtttaccgtgacagctcatttttgataagtattgttgttgctgaaaggggaaagttttatatattttgagaaatataaatgaaatttaaaggaaatgtatatttaatctaaaacatacgaaatctgaaagtactcaagtcatctggaaagcattaggtcttgaatatgaggaattttctgatactaacagagaaaaacacaaaggtgactgaatatacacacagtcttcccagccaaaacatgcttgcccttgttacaaataatgactgctaatcatatgtgaaatgatacaattaaagttaagatcattattaatgacagctaaatgattaaatgttattcaatataataaatatcctctctttggagttaggtgacattttaaagttatgcatttggttgtttggtttaaactaactgaatattaatctgccagtatcttgatagtataaaatatatccacaaaagtgaacatcttggcaaaagatagattaatctctgtgtaacagaaaggcttgtagcaacacccacgtaataaaaacactccacttgaaactcaagacccagtttactgtttttgtttggatcatctttacccaggttggcaaatttattaaatcaattctttttttctagatagctatggacattctcagagaactgtattattaaagaatgggtcaccctagagtaaaacttcaagaattgtggataagaaaaagaaaatcaatatatatgaattccaactatacaacacaagctatccttacaacaaaatggtttaaaatccctgtccttaattttaaaggcatgaaatgttgaaatactattaatttgattacaaaaacgtgataaagcatgagatagataacaacaatattcttcaggtgattaggtatcacagtattttttttttcctaaattaccaggaatccttaggaattatactccactaccttctacatcttgaagaaaatactatgactggataatatttgctgtatgttgattgtcaaatattcccaaatgcaaaacttaaaaagtttgtatctcccatgtgtgatagacaacatgatctctattttattcacctatcaaaagaatatagtattttaattgtaagttcactagtatgtccatccagtcatgtattctttgtgataatggtaggcatttaaattctatcattctaaaatatgtggccacaaaaataaaatgctgtcttttttgttgttgttttttgagacagagtctcactctgttgcccaggctggagtgcagtgtcgtgatctcagctcactgcaagctccacctcccgggttcatgccattctcctgccccagcctccagagtactgggactacaggcacccgccaccacgcccagctaattttttgtatttttagtagagacagggtttcaccgtggtctcgatctcctgacctcgtgatctgcctgcctcggtctcccaaagtgctgggattacaggggtgagccaccgcatctggccaactgctgtcttattttctctcccatgctcattacttcagagggagaaacccctagcaacatcatattgtggtgcttctatggacactcatctaatagactatgttatctgtagcctactataatgagttatattattcaggaagtcagtttgatccaaaacatatccaaattttatagaaaaatgctagcttacaaaggtgttttactgtgtttaaagaatataaaaaacctagtattggctgggtgcggtgtctcacgcctgtaatcccagcactttgggaggctgaggtgggatgatcacttgaagtcaggagttcaagaccagcctgaccaacatggtgaaaccccgtctctactaaaaatacaaaaatacacacacacacacaaaaattagccgagtgttatggcaggcacctgtaatcccagctacttggggggctgaggcatgagatcacttgaacccggaaggcagaggttgcagtgagcagagatcatgccattgcactctagcctgggcgacagagtgagaccctgtctaaaaacaaaacaaaacaaaataaaaaccctagtatcagaagaataatataaatagatctttctcttcccctctcatggcaggctgcatccataaaattaaaaaaactgtaaagggttattagtttttcctatttcagttttcaccatctactgcttattaattacttcctattgcattttcattgttagtgaatatttggataaataactgaattctctacttcccttagtctatgtaggcctacataaatggattccatatacttttgtgctgtcacagtcaaacaacaacaacaaaaaaacacgactccaactctatggggtgaagaaagatcttgctatgaaattcagattttagagatgaatagttttgttttgtttaaataggaagtcatgttgtaggccctgattttttctgaatgtgtttgtttaatggaggaaacgggagagaaagagtaaaataaaacaagaaaaagaaattgaaagaaaaattctatgattagagattcaaaataaaataatattgaagttattgcttgaagacatgatggtattttaaaatataacagctacttttttctaaatatttaaactagcataagtttgccaatatggggactctgatggacaaataataaacttccaataaatacttgtttaatgttactatgcatctctttagaaaaggtatttctttcatcagaaattcaatgccctatcatttcaatagctgtattacttgggtcaaggcaaatttttttctaaatagttgtcttgtttgtagaaaatattttaccttgtttattagtttaggatagttccttttctatgctttttattttttatgcaggcttcaatgtgccacttcactttaaaaatgccaaatataaactcttgacttaaaaatcactacacactcttttaaccattctcctgagcattgatacttctgaattgcttgctttcttattcctgtctcttgaaagtattccccaaagaagtaagattgttgaagctttctttccatttgtctttacttttcactttctctggcacacatctttgtgtgcatggaagcatagtaccatctcaaatcacaagtttttctgattatgactcttaacagtatgtctatctcagagatgagtcatatacacctatatgcatacaagcaaataaggccctttgtcaaggttttcaccttagttttcttaagatgtggaaagtaatatgaaagttaattatttcctttaaatttttttggctaaggataattattttccttttcagtgtttgggtttgcctgtttgtacatgagaacaaaaagagagaaagattaaataatttcaattaggttactctgtctcattttttcaggcaaaatgttgaagaaattagatttgatttactgaaaaaaatcacagaaaaatgtttgtacatacatatactcatataaaaactacaacaaaaacataattttatgctgccaacattcacagtatcacctaaaaaaaggaagaataaacatttcatggcaatcaagtttttattgttctttattcacttttagttactaaaaaatgaaatgtatatgaacaaattaaatatatgaattaaaaactgagatttagccaaaaggtgccaatcgcaagtttgttgtaggtaaaggtcagtgatttgcatgaattaaatctctttaaactttgttctagaaatgattaaatgcaaaaatctcctgcaatacttcactaacttactaattaaaatatttcttcttaaatgaatagtagatactgatttgcgacttcttgctcatttataacctgtaatatattaactgtatttactgcacatttacatcatttactataacagcttaacaacaatccttatgatttgtcaacatgttgaacagcaaatttatcgtgattaagcaaaattttattaagattaatgggatataatctgattttaagggaattttccaaaataacagaactgagctgaaaaaatgcattgttatgggtatagttaatccaacagaaacctaatgctatgttatggaaatggtcttcttttagctgtcatacatttaaaaaaaaaccacattttgaatatcctcaataagaaggtttagattggtaaaaagcaattaatagcaaacctcgcaacagagtattaaacaatgatttaggctcacagatgataaccaaccctttcagtaagaattgtagaagcaatatctttcctcaacagcttcacatattggagaactcagtgcttcaacagagtgatccaaagaaattgagatttggctcaaaggccaacaaagttaataataaaggctgacttaccttctctacaagcttattacattcttttattctttaagccctttctcctaaagatataaaattggaaacagtgtaccatagtgggaagtctggagttgatgttgaaataattgacagaatatataacaatggtatttttaggtagtgaggctattgataccaacatatcacatagacaataatgggcatctctaattctgctcttcttagtcctcatgctggggaagaaagtctgcttttgaattattaaaaatggaagaaatgatggatttgactatttacttatctaattttggagtggaatgctatcttcagttatataaaatatccctcctgagctgtagttctcaatcccattacatcccacttcatccctcatttgcgcagctcctgctgccacagtatccatgcctagcataaaacaaactaagttaagtcacggtggggtgccttttgtgaggccactcagagtagaaagaaacaaagagcaagacagagatgcgaagaacataaagaaaacaaataaggcattaaaaaaaggagaaataagtgggaaggaaaaataaattcaccaggctaagcatcataaaatcacacacgctcttaaaatttggccagtaattaatagtagtagtattattattagtctttgttttgggagattgccttcagagagctggaaaattcatttcgaattaataagggtctttttctttcagaagcatctcctaaaaataagaacgggctaattaaaaatctgacagccaccccgatacttacagaatttttgcatatgcaggatagtcatcacaaattgtattctctgcacgtcatgtcaaaagtattctcatacactactagagggagcttaagaatttaaggtgtgcaagaatatatttctatctttggcccaccagggccctcttgtaggaggcctgtgttgggcgggagaggcctagtcgcagaccctgtcttttcaaggagaaagcccgccactgcttcctctgagtctggagataaaaccagtccggcattgctactccctagctctctccccctcccttaattcctcctctacatttcaggcgcatttctcagagtgccacctgttcctgctgcttacccttttcatgccttcgcattgacaaaagtgagctcaccctgcggtaaccttgtcaggcagggcaggccagtggccagagcagggcgttaggacccttttggaggtagtcccaactgggatgctgcaaagcgcttctcttactactgtcctccctagatgcagaattcgtccctccacccctctgtccaatggaaccacagggctgggaagattttacagcgtcagtacttctctgtccgtccacagcccggtccctgaggctctgtcctcgccaggtgagccgagcagtacctgggcgtgggaccgctggcacaaagggcacccagccccggcagaggctctaacctatggcacacgcgggcatatagtgccacctggtagagagtcaacagtggtgctttaaaatgcaatacaaacccctcctacatttgttgtcaaatcacttcacgattcccaggcaggcactggattctgcgcctgggagtagggctgggggggaacgctgcctgcatgtgcaaaaataacccccgaagacgcgagccaagtcctgggttggagcctctgcagcctgtggatgcccgctgggcggctggccgtcccccgggagccccgcggggctggtccgctccgcctgcgcacgccgggcggcgggagcgagccggcgccgactttgggagttcctggctgccttgtatggagggctgctcccggcccgtctccgcccgactgctctgacgcccagccctcccgctgcccacccccagccgcctccctctgacttgcctaagaagccagacggagcctctcgcttccacaagtctctctgcctgccattccccgattcctgcagccacccccaccctccagcgccgtcacccctcctccgcccccgcccccgcctccgccttcgcctcggcaatcgggggaataaatcagggaggaaaccgagagggagagcgagagcgcgcgagcgccggcgggctcgccgaggtctgtttccaaagtcgcccttgatggcggcggaggcaaggcggccgcggcgcggagcagccgacgcacgctagtgggtccgcccgccaccgccccttcctcggcgtccgctcccgcccttgccgtcccccgcgcggctccgcgcctcgggccccgggcgcagccagccctccagacgcccgcggtcccggcggcgtgtgctgctcttcctccgcccgcggtttccagcgccgctccttcccccgcttgggcagggagggggcattgatcttcgatcgcgaagatggctgctggctgcctgctggccttgactctgacacttttccaatctttgctcatcggcccctcgtcggaggagccgttcccttcggccgtcacgtaagtcggcgggccgggcagggagcgccggccgaggggcgccgcgggagttgggggtgggggtcggttcccgagtcgcggggcttttccgcccgtgggggtggggagcgagcggccggggagccaggctcggatgcggagacgccgggcaggcggtgcgcgccgctcgccgctggaatgcgtcccgaaccggcgtctcgggcgcctccacggggccgggcactgggggccgactgtcccgggaagcgcccgccgacgactcgcggcgtctcagcccgtctctaacgggattctctagacttcagagtgcagccgtactggggaaaaaagtttccagccagctcacccgctctgattcaacccagttcaataaaaagttatgttttggttgggtaatttacaaacaggtaatttcaggcttgccgaggtagcgtggacttcccccgcacttggcctcggagatgctctttaattgctgtagtgcccaaactcgttttatcccacgttactggatgcacttgacagccttccgattagacgcgtgctggctccccgcggccgagcgtgctgtccacgcagggggctcgcaggtactgggaccacgcgatccaacctccccaacccattatttgaaacatctaagtgtcggcagacacgcggtccctgttcttcaaatgaatagagcctattctttgaaggagggactatttccagtctcctacaaattttcttttatttttaccatttctaaaataacttttaaaaacctcgctgctgttctggaaatagagggcttataggtagctatagtcacaccacaggaagggaatgaaaaataataattctctcctttcttagcaaaatagaatcaaactcaatggcacatataaatatatacatattttttaatgcaccgaatagcctatccggcattctgggaaagcatttattttggttcttggagcttctttaaagcttctaaaggtaggtaatcttaagtggatgagtcactttaatgcattttacataacaaaaacaaagcccaaggtagctttcccggtatttatgctgctgggaattacttgctgtcctttgttggctgagtgctgaatacaggagtttttggtggaaagtaacagtgaatctttagcggttgaaatcctgcggctattatttaagattcagttttaagtatttattaccttaggtgtcagtgcaagaatctggaggatgcacattctatcccggagaaggggagtgtctaatttttgttgtcattgagttacagtaatgttcctctttagataatcttccataaaactgattgcagatcctttttgttatgaagcaaaagggtaaatgccatctggagatcttcgtttaattggcaggatgttccagtcagatatttttaaacataaaaagagtaagaatcaccctaaggatgcttcagaattatttactcttattaaggcatcacacttccatttaattttttaagtctgtttgttgcttggcctgtaaagtgagaactcaaatgagtcgcttgcattctgtgtcaaataaataagtggctctttaaaaaacaatcacttcctaaatgtgttccgattactcatttttacagtgttgtttttaactgacaatttatcaatatttttatcatgggaggggatacatcatcataccattggggaaaactacaacaaaatacaaccttttattcctcaacatactgtggtaaaatattaatgtaaaaatccttattgttaagaagaacatctgcaataatgctttcctaaaattataagtaaatcaattttcatggtcagaaatttactagacacaagaaagagtatatatagtgggttaaaatgggaagtaggacatcacaatttcttttctttggaaggatctgaaattttttttaacgatgaaaattcaagatattttcaaattatataagacattgattatttaatgaatgaaatacttaataaaaggttttgtggagcgaagtcaatctcctgtaggtaatcttaacaatatttttggaagccttctgcatcttcagtttttcatttgaaaagttagtaacactgtcttctgaggaaagaactgatggttgacatttgtacttcatgttagatttctgaataaactttatgaaattaaaaaatgcaatatttttcataaagatgtgccatttgcttttctttcgagaaaagaattcatatgcactgtttaatcaggacaaatctcaaatctttgggggaaaatttcaaatttataaaaactgagtgcaaagactgtagtgtcaataaaggcaaattattatgcttctgtatgtaaatttctctcggaatcattagtaaatatttttgggtttttttttttgccagtttcatttttcacagaaaaagtaatgtaagaagtttttatcagctgaagaggaagagcatgccatcacacactataaaattaattatgcactaattggagttggacttcaattagaattagtagttcaaagtttttttttaaaaatatagagtgtttacatttgtgtgaagggcttaaattctattatggtaaaacaaatgatgtgtcagttaagtatcttctttcattttttgctctcctgtttaacatacattctaatataaattttcttttggattaaagtagtagttaacctgttctaagagttaacactaaaatagatgtttttcagacaaggaaattttgatatgattatttctctgggttaggtgtttcttttggaaatgtttgtctccctaaggtgtgaaacataaatacatgatatggtagcagccacataatgtgtattggttgatatataaatggaaaatatatcatttttatgctatagtatgcacatgtcgtattggtatttttaaaatgtagctttcaaaaagggtagttgtccgtttttctagaaataatttcttgtcacatgttaaaagacttctattttaatatttagaattacatgtgtgatagccagtattataatggtaatttaaatttgtccttaattttagaatctatttacaaatgcaattaaaaaatatatagttataactgttaatatcaaacttttatctcagtcacatcaaaatgccagtcagtctacaataattggctgagagcctattggtatacagggattttaatataaagtgtacaatggtataaatataaaactaagaattgtggatatccacaggaaataagcataaattctcatagaagtatagtacttttggctttaattacttaggatatttttttttcctgttattagagaaatttgtatttaaggctataaaggagaaattttgtatgtcaggatattgtaatggatatctgttccatgcattataagtgacataattattctcacttgaagtcagcagtttctgtttacattttacatacacaaggaaatgtgccatatgatcaattatgagataaaatattaaatgtaaaataaaacctgaaacagtgaacattaataaacttttctcaagtctttaattttgttctcatcggcttaaccatataacatttactattccacagatgtatgttttaaaatatgcaacaatagatatatttttccacgtaagtagtaatattatgttaaatttattaatgttacacatagctatatgtgtagctatttggattggcatttgaatgaaaattaagcagactgaaatggatataatttttgaaaaaaatgtaagaaaatacaagaatctaagcatattatggtttattaaagggaaatgaaatgtgcctttattatctccccctcccatggctttcattaatttaatttaataaatatacataaaatttgaatataaagtaggtggttcattttgacaatagataagagctttacagttgttttcttcacaacaaactgactgtgtagacatctttctgttatttctccaacattgataaaactaacaataaaatactcttctttctagggtttacacatagtaaatttttacaaaaacataacatatggaaattattattgtgctaaaatttagtatatataggagtatatattcataaacaataatgcattgagaaattttacaaataatttttacaatagtgctcataacaaactatataatttacatattctctggagtatcattatataaagcacctcttaaggtttctcttgatttccctatttctcaatatagatgcaagtttccaagaatttcctagcacatgtcttcaagctatttataactttaaattggagatttaaatgggtaaaatgaaacatatcttaggcaaatcatgcaatttgttgatctcatttaatgtcttatatgtatggacataagcatttctaacgtaagtatacataacattttgggaaaaaaatcagaatttcagtatttcaaaaaagtaacattttattgttattaaaatgacaacggtccattatttctattaaaagagctgtctgtggtagtgtttcaaaaagcaggtcagctgctttccatggggaacaaactttgttctattatatcgcctccacatttacttaaggcttacagtgtgcatcaagcactgtgtcactaactgtgtcaaccagtctttcttttcatgaactatctgtgagcagtaccacgactgttcccaaggctttcatacagttgctttccagtaaactaggaatgggctgtgatggccaaccatgtagcttacacaggattcatttttttgtatgtgcactgaaacatgtaaacgattgcgtagtgttgtttacagagttgaaagaaaaaggcaattgacctcaatgtcaattaagtaaaagtggcagcactttgtgaaaaaatactatgttactaccttttccttgagagtccaaaatattaacatcgtataattagataactttcctagtttgtgtcactatatagtattctatttaatagatagtattttatgtatatgcaaatacacatatatacgtgtgtatgtccatacatatttttaaaactttaagtggattgacagagtagaaaaacctcagtaaggtaagtttattaacaagtgtgcataccttaggtcttctgtcagtccacaactgttttcagggattaaatctaacttaataacaccagcatttaagaatgatttgccaagacaattaaatgagatattgcatacacaagcagcctgaaaatgctcaagtcctatagagacgggttactaacataattgacaagtaattaaaaaagtgattctaaagacagttttgctgtcttttaaacaagtgtgagaaagaaactataccatttgaaatgttggcacctattaaaagttctttacatactaagcagttttatttctttcatttagataagatatactttgaaatttagaattaaacatatttggtggtgtgatattttaggaatgaaggcaaatgtgcacaggtttaaaatttttatttgtaaaatataagctcttaaatatcccttctttgtaggctttacatcttttgtagtaattcagtacatagaatcagctactcttagcagtttttaaaaatgagtaaagaaagcggtcattgctcctttatattttgccacttgtttgtacaggttatgaacgaggaaaagattgactttgtggcctcaacaaaccggcacactttttatagttaatttcaataattcagaattaggctgttatatataaagcaatatttgaagttctctttgaatatgaatgtgggatatttctggctaaatgttattttaacatttgcttctgctgattttttttaaccatatgctctgtggatttaaaaaattaggatacatttaaaattctgtatcataaatggaagaaaaacttgaactggtggcagtagaaaataatggtgctggccattttaaatgcttcagatttggggataatcttactgtctatttgaagctctttttttctgtgtaattaaaaatacgctatggtggtcttctggcaaatgatggaaagcaattccaatgttattttattcaaataataaattctggtttctctctctttcatacacatgcatataattactattaaccataacattattatttgtatataacatcaaatcaaatgaaaaattttaaaatgtgtttctcttaagttacccatgatcagacctcaatttcaggtccttttcacttcaatctgtgctccctgtttcagatttcctgttatcaccagacatttctctctaagagaaattgttgagggattttgatatacagataaacctgtaatatgtaatcaacacataccaaagttgtcaagcaagtctagagaattgtttcttttgatatttgcccaataccttagggataattagggaaaagaggggaaagagctaataaaatttttctaaggtgcatactgtcaaactatgtgaagggatggttaaatattaataatgccatattttgagagttacaagagggatggtgcaatgaaataaatgggctcaggcagactgcaaaaatctcttgtttttaaaaagtgagcaacaggcattgtggtgaaaatactctgaggagtgatggatgtgtaagtggggcagagagaagagccctcagatttatgaggtgcaaaattacattaaagatactaaaggtagcagttggttatttttcttaatgcttctgttttcttcatttcccatatgagcttggttatattggaaatgctgcttcctaaacataataatcatttttagagacttaaatattcacatttggaaattcaccttagagaccaaagacaataaaattatctagatctcagaacataagtacttaaaaattcttagtttttatgaaattctgggaaatggtttattggataagaaacactagtataacatttaattaagagcttaagtgctaatcaacaagaaagaaattctgttagaaaatttttttcattagattacaagaaagaaataacttgcaggtaagcagccttctaggtagtatacttaaaactaggcttctaaataaatagtacattttatttttgaagttgttttaatttatattgcctttttaaatatttcttgtttcaaatattttttaacaccaaatataatttaattcaacaattaacgtgatgatgattattattcagtgcaaattacgtactgcgctgagctacatgttgagaatacaaactgagggaagagagtccctaaggaaaacattagcaactccaagctgactatggaacactgggatacatcagagcatgaccaaggaaaaagtacattgcatactgaaggggcatggtctaaagaaacgtggtctgttctttgttaggcattggacttgtcaattggaagtgatgttggtagctattggcttaagtctggttataaatttcttgcatcctgacccaaggaggggatgagcagtgctcatattacatcgacatttgcaatagccctgtttggtgtaccaacacaaatttggtcttctatcctgtgttgctgttgagatttttaaattaaaaaaaaaaagtaataggtttgaatcataatatgtagaagatggattaaggcgggccagtatattaggcagaggcaatgagactagttagtataccattgcagcattcactgaaccagagatgatgcccgaggtttcaaaaagattagtggcagtgagaaggtgaagcaggtatgaagtagaagtacaatttcaggacttggtggttgtgagatttggggaatcaggaaaggaagaagaattggagatgacttttagatctctaacatgtagatcatgtgtcattaaattttgtaggctagagaacacaggaggaatgcaggttgatgttgtgagagtgggagtaggttgatcgttggacatttggagtttgcagtgtcttttagatgtctgttaggcccttagaaatatgtatctgggccgggcatggtggctcacacctgtaatcccagcactttgggaggccgaggtgggcagatcatgaggtcaggagagatcgagacaatcctggctaacacggtgaaaccccatctctactaaaaatacaaaaaattagccgggtgtgatggcatgcgcctgtagtcccagctgctgaggaggctgaggcaggggaatcacttgaacccgggaggcggatgttgcagtgagccaagattgtgccactgcattccagcctgggtgacagagtgagactccgtctcaaaaaaaaaaaaaaaaaaaaaaagtatctgaagagagtttggagacaaattcagagagcaatacttttgaaggcagaagaaggatttttttcatttatttaactcatatttatctataatctactaagatagacactgagtttcaaaagaagggccttgatttacagtttcattttgtggagaggtcaaactagatgaccccttaaaggaagtcatcaggccactgatgaaagaaagaagtctaagtagcgtgtcagggacagaagcatggtttcagtggcttgaggagttggtcaagttgagaatatggagacaagtgcagattgtttcttccaggaattcggtgacatgaggaaagtgagagataatagagtaaattcagaggaagacattatccttagcaaactaacacaggaacagaaaaccaaatactgcatgttctcacttataaagtggaacaacataatgagaacacgtggacacatagaggggatcaacacacactgggacctttcagagggtggagagtgggaggagtgagaggatcagaaaaaataactaatgagtacttaattaagtacttaattaataactaattaagtagacttaatgcctggctgatgaaatcatctgtacaacaaacccctatgacacaagtttacctatgttacatacctccacttttacccctcaacttaaaaataaaagttaagaaaaaacaataaatagtaagttaatattaggccgtttgggattgtagattgtacaaaaccataggactatcttaaaccaaaaagagaaatatttttaaatggtagtggagctggatgatccatcatgggagttcaggtcaaggatgttccaacaactgcagaaaaaggtgagactgctatcatgataatctctcaagtcattttctgcttttctttgtgtcacttctttcttctctttctctataaattggcattatctgcctccagtgctcatggtgttgaatggttgcgagggattatgctttctcctttgaagccttgaaccagcttgagtgtagaattctagtcctaaagataacctcccaaagaagatgtgttgacagtctgaatgtgggccagatggccacttacagtccatttaattgtgaccaggagatgggatttggaaaagagactctggttgcctgagcttgggttagttcaccatatctggtccagtcttcttaggaggtattacatggtaaaaggccagttgctattaccctggataggggaagagccgattctcagaaaaaggctctggtgagaagggtggggaaggtgtggaaggctgtacagacaactaaatagtgttaccagaagggagattccagtatctcagagggagaagaccaaatgtcagagagatgaaagcaatgagatgccatgattgatggatgaatgttctgatagaggcaggtgaggaagggatcaagactaaacacaatgtcttacaaagtaacttttgaaatatgaaacagccttgagaattaaagcagatggttggaatacaggatagatataattttaatttactggagatgtttttagaggaatgatttaaattacatattccattctcaagaaggaatgacataattcagaaatgtaatacatacacattagtaatattcaaattttgagaggaatggactagagtttttctttcagtggtagtaacaagactccagtttgccactatattacctttggacacagcaacatttggttctcacttgtctttatttttcatttacttctttcctaggagagattatcatcttaaagattcatgtagttttataacatgtcgttagaatttttttttttttttgagatggagtctcactgtgtcactcaggctggagtgcagtggtgtgatctcagctcactgcaatctctgccttccggcttcaagtgatttttttgtctcagcctcctgagtagctgggactacaggcgcacgccaccacacccggctaacttttttgtatatttagtagagatggggcttcaccatattggtcaggctggtctcgaactcctgacctcaagcaatccacctgccttggcctcccaaagtgctaggattacaggcgtgagccgcgacacccagccgatgtcattagattttaagtgtgtggtgcttgtggtagaaagatcttccagtaatatcattgaaaaagaaacagataaaagaacaaatagttctttcctttggcaattgagcattacttattcattaattttaagcagatagtagtggtttactgccccactctattggtgcttcctgcccccagtagaagggagaagttttggtcgaaacagatccttgtcaagaaaagaaaacagtaaactctagaagattaaaaaaccactggaatttgggcgagggctcgcttgtaggctcagctgttggggaggctgaggcaggaagatcgcttgagcccaggagttcaaatcttgcctgggcaacataggctcatctctaaacaaataaacaaacaaaaaactgacagaatatccctgcaaagcatatccttggttaaacctcactgaggcatcccaggtctcttgaaggtctggaaattactggcacttgccatcacggcagttcctgagtttccaagatgaatgaatgaatggttaggattgcaaatgccagtggatctaagaatcagtcttcatctcattggtaccattgcagtgtggaaaaaccatgcttgcggtttgtggcaagagataagaagagttagggtgggctatttatttcccttttgtgactttgctcttttttctctcccatagatattcacagtttgaactaattttggtgtctccacctgcagtgtctgaacagtaataattactaacaatcattcttcaattacaataatattgttttctgacatttttgagctccttctgtatgccaggcactattaattagtactctccaatttttttttttttttttttttaagacagagtcttgttctgttgcccaggctggagtggagtggcgtgatctcggctcactgcaacctccacctcctgggttcaagtgattctcctgcctcagcctccctagtagctgggattacaggtgcgtgccaccatgcccggctaatttttgtatttttagtagagatagggtttcaccatgttggccaggctggtctccaacacctgacctcagtaatccacccacctcaacctccaaagtgctggggttacaggcgtgagccactgcgcctggcctcatgttttttaatccatctaaccttcaaggcaatcctcggagataagtattattattatctttgttttgtaaatgcgggaacaagtttagggtatgaagaacttttttgaatttccttaggagttcagatttgatctcaagcagctcaattctagattcctacacttacctgctgaactttgctgccctttgcagaagctttgaggtcttagcatctattatctcgcctggctgcatattccagcaataagattgagagagaggagtcatgtaaagtagaacataactaactctcagccttgatttctccatctgtagaacaaagatagtatttttgcttcctgcatccaatgttatcgtgaggattaaatgaaagaatgcgtggggaactttgaaggactgtttaatagccaggcttcattatgtgtgccttatgtggtttttctgcctttaagagatcacgaattgatgactatggattagtgagctagattattgtgctaatatataaccatttgggccatgagaaaaacttaaaatgaatggaaaaagggatgcttagcaggtcttaaaaatgtctcctcctaaaacctgtgcagtctttcatcataaaagggaaagggaaagagatgcggtggagtgtaagtggaatagggtgggtgaactgttccatccctaggttaaggacaaaaccagtgtcctaaaagagaccgtgaagaaagcagaaccacaaagcatttgatgtgctttgttgtgacatttcagtcagcacctgttgtaggagaactgtgccacagagagtgaatctatttttaaaagtcatagctttaccaccaatatcctctcattgtcaaagatgtgagtttttagccccaaaacagaatatctgaaagttaataatgcaatctatccaggatgtttatagaaatgattccagactaccctacaaattgagcaagtgcaggatagtaaaatcaagaccagttgcgtttttcgcaaccaatacagaagttggcaaaaatctgccaagagcgtactgaaaaaggccagcgtttacttgactcatccagctgatggttagttacactcatctaactccagcccttcactttgcaatataaatggagttgagcctctcataaacactgttctcttgttggtagaaatcaaacactgaaataaaatttctggtgcaaatttggagttgatttatggataaaagatgttttagattaaccaatacattaataccatgactaatgattaatgattacaacttgatgataaccattgaagcagcaagctttcaatgccaggaatctggtttttttttttttttgagatggagtctgtctctatcacccaggctggagtgcaactgcctgatcttagctcactgcaacctccgcctcctgggttcaagcaattctcctgcctcagcctcctgagtagctgggattacaggtgccaaccaccatgcctggctaatttttttatattctgagtagagacggggttcaccatattggccaggctggtctcgggctcctgacctcaggtgatctgcctgcctcggcttcccaaagtgttaggattactacaggtgtgagccactgcgcccagccaacatggcctttttatagcagtcattttgacatttgccatagaaaagaatgtgtaaaatttttatgaagtttgtcactttaaaaataccaccctgtctttgtcatgacattttattagaattgacttaaatttacatctgcaaaaatgttgggggacttaaacaaatgggccatatgaagcctcaggaagatgggcacaatggaggctgtgcagactgctctaaattaaacatattagctgcttggctgtcagtccaaacacctgattttcctgtcgatataagtgtagaaattggcattaatttttatgaggcaaaattttattgtgaatgggtagcttagttcccagaggattgatacatgggtgtcaaggtctattggtgagtaattgtttaaaatttatatttttgctcgatggtaatgaataaacataggggaatggtaactcatcacagaccaaatcatgcgtgataattatatgaggtcattcatctccttaacttatcagatgtgacacaacctgtctgtgtggcatctaaaggccagctgagtcccggctgtacatgactgtgacagaggagccatttgaaggttgcaagtcttggatttggtcctaccgcttttgggtttttccacatgtgaagtaaattggctcctggactctattcttgtaatatgcacagggagccaaaacctggggtcagcaggctactcagaatcgatttttttttccttcttccttctgttgcctctatatatctaccctaattgcagagaaacacatacatcagtcacatacacagatatgtacatatttatatgatgtgtgcatacatataatacacattacacaataaacatcaaatatatattataatgatttatatcaagtgaaagttataagatatgaagaaaatatacatgcagattcagatatgctacatgtacatagaatatatacatttagaaaacattataaaacctgaaaatgctttgtagtatccagaaatgccatcatccatggaaaagattgtaaatttattaggagtaactgaaacatcaaagtggatgtgatatataactgctgattattttacttttttgtccagtcggaatcctgtgatcctactctttcacatcttcaaacccacagtggttctgtattgctctactaactcccaaaaattgctaagttgatagatacttaagtaaagccagaaccatatgagtctatgctatggtagttcagaggactcaaggtaggcaatctggtatggtgggaatattcaggattttgagtcagagaatcccaaggttgaaccctgcttctggtatagcctgtgtgatcttggaaagttaattttctttcagtttcatttcatattctgtaaaagagtatcacataccggaccttttaggggaaatggtaaggcttaaatgagaggccatcaagtacttgtctatgtatattccactgaatttattgagcaaagggtgaaaagtgttagttctttcatcttttctgattctaatgtggagccatgagaactagacatttttcttgattttctaatctactcctggaggcatctatggagattagtaaagactactgttttctcttatgcttttcacatttatctgattagaacactaggggaaaatctctggaatgggagtgggaaagggaggtccaagtcataaaataaataaataaaatgcaacagatggttccttgcttatcgtcctgaggttatgtttaagattttttatgcttgtgtcatggcttttgtctgaagctgaagatggctgtttgctccatatcctttctgttcactaaatcagtacagattcctgtcaagttacacaggtctcctataatttaaatggatttagatgttggatctatgctgaatatcattaaagcttcattcttgtatgtgactatcaagtaattacaattctaaaaagtgatcatatatggtgtggttgcagcctttctgttttttgtttgttttttttttatttattttttatttttttaaagacaagatcttgctctgttgtccatgcctagctagttttaaaaaaatattttggagagacggagtcttggtatctcactatgttggccaggctcgtctcaaactcctgacctcaggtgatcctcctgcttcagcctcccaaagtgctgggaatacaggcgtgagccattgcatctggccttgggttgctgcctttctaatcaggtttcctcatctgaaacagaggacagatattcatttgagtgactttttaattctcctcaaaatggttcataactagtaccatattaatggcatagaagagaagtcattgcattaaaaaattgatgcttttgaacatcagagtttaattatttcatggaacttgcatggttggttaaaagtgcagattcaaagctcagctctacaactagctgggtaacttgaacaagtcaaccttcccattgataaaacttcatagggttcttgtaaggattaaaaatattcatgtaaaacactgcatgtagaaagcactgaacaaatatactctgattagaagcaggataacagtctaatcaggtgacatgggttcctgtttgcttccaccattaactagatgtaagacctaccttcgtaacatcttgtaaggaagaatttctggctttagcactatccaacacataattgctcacctcctatttcttaaaaacttggttttagttgttacagaattgtcattcatgtatctattgaccataaattagatctttcttggtacttgagcactcccatgcttgtggttatgctcctgaaaagtttattttcccactgttttaagtttctcctttctgaaagcaaaaatcatgaagtttgatgttttcctctcttttaaacattttgctaccatccaaattgtgctaaggcatagtatggcaccaagcttctttttgtatctgattgaaggacttatcaagtacagataagttcccccttatccactagggacacatttccagaccccccagtggatgcctgaaactgcgtatattactgattaaaaatatatactatgtttttgcctatgtatacattacctatgatacagtttataaattaggcacagaaaggtgattaaaacaactaataaaatggaacagttataacaatacactgtaataaaagttgtgtggaggtggtctctctccctctctaattctgtagcacttttggactttggtcgactgcgggtaactgaaaccccagaaagagagagagcaaaaccttgaataagggtaggggggtatattgtagtatataatgaagtcattgacctttcagaaaaattggccttgtgtgcagaaaaataattttagtggcccattgtccctgatgattttagttctgtgaaagaggccctaggtgttctcccttgacaatattagttctagtaatctttgcaaacggaaaattgtaacgttaaagatacataagcaataattaccatactacttgtaatatagaatggcacttttttttcctgctaagatgagcaacacacatatcatcatggtttaccttgagtaataaatgtatattatgaaatattttcagaaaagtaaaaatcaattacattatgctgtttaaagtatcaattctaatttttcaagaatttgtatctgagctcataaggcattttaaagtatagaagaggggtgtgtgcagtcttttatgtgcggccgtttattgtgccagttgatgagttttcctcctagtgtagaggcatgaataaatgagaagagttagaaatacatgttagatcctcaacgtggatacaaaaaagatgtgaatcagattatacagaggaaatcaaagactgatgactaatttaaggttcagtgaatctaaacaaaccaaatagaatttatgtatttatttatttatttatttatttatttatttatttatttatatatttttgaagcagagtctcgctctgtcacccaggctggagtgcagtggtgcaatcttggctcattgcagcctccgcctcccaggtttgagtggattctcgtgcctcagcctccctactagctgggattacaggcatgtgccaccatgctcggctaatttttgtatttttagtaagagacggggtttcgccatcttggctaggctggttttgaactcccgacctcaggtgatccacctgcctcagcctcccaaattgcagggattacaggagtgagccaccacgcccagccccaaacagaattttcataaaggcattttatgcaaagataaaatgaatcctgggttgggcgcggtggctcacacttgtaatcccagcaatttgggaggctgaggcgggaggatgagtttgagacctccctttactgaaaattaaataattgtctgggtgtgctggcatgcacctattagtcccagctatgcgggtgagaggatcacttgagcctgaacgttggggctgcagtgagctatgatccagcagccgcactccagcctcggcaacagagcaagactctgtctcttaaaaaaaaaaaaaaaaattgaatctcatgtttaaaatttggtaatgtaaatttatttatttatttattttggtttggtattttctattctgtgtagcatactgccacaaactgaatggtttaaaacaatatacatttattatctaacagtttcaatgctgaggagtcgtggtggccccttgttcagtctcacaaggctgcagtaaggtgttgcctggactgcattcccgtatggggctacttcctgctcctctttcaaaatcgtgtggttgttgaggccctattaaaggtcctcttacaacatggcagtttatttcttgtagactagagggaaactctcttcattcagaaagggggctcaatacccctttgaagggcattcagctgattaagttagatcattcattatactcccttttttgattcattgaaaatcaagtgatgtgagatcggaattccatctgcagaatcgtgttacctttaccacataacgtcacataattaagggagtgacatcccttcatatcatggtccccactcacactcaaggagaatgggttctgcaggagtgggaattatgagaatcatctcagaatcctgcctaccacaagtgttatattagacagcaatcacaaatacaccaaaaactaaaagatgtgaatgctcatttctttcctactttacgtgctcacagatttgggaaatgctgtgaagcatcagatgacccatcactcttttgccttcaggcaaactgtgttgggtcacattagttctgatccatcctataaggaaagtaaactccagtagctcattaactagtcattaagggtgctgtcatcattagttagctgaacttttcactttctgcaaagaagaattctctttgctatggtttaagccaatttataccattattgtcaataaatatgtagaaaaattataaaacaattcttttgaaatgtaaaggattatgatccttccaaattaaggtttatacttgggtctttcctgaaaaatatccatttatttgcctgcataaactagccaatactctacagtcctaaacaacatctgatttttcatttgaatcagtatgtaatggtaatgtcctctaacgccccagttataaagtattaatgatttcttcatttcagtgagtagatttaggtgaatagctatgagttctgtttttcaaagaaaaaaataacgatgacgtgctttttaatactgcttatgtactgggtgctcagtaaatttcctttaaaaagtaggtccttcatatactccatacaggtgcttccctgctcagcctgtgcatgtcctaagtcattttattttcagagtgctgctggttgtctgatttgttcaggatttttcttgttataagtctagcaataattaatttgctagcaccagggaacactggtcagagtaagtgtctaatttagtgcttttcacactaactgtgctaaaggggtagggctgatttatttattttgtaaattttatatccattgcaaaggtatatttttgtgaaatggaatgaaaatcaattaatagaaaaatgaaatttaaaaagatatacatattataaaccttcttttacttaaattccacagccataaaattactctttccaaactgttttaaaagtgtgtaaacactcccagtttgtgcacttttcttgtggactggtagacacagttcccagattagcagcctcagagtagcataatctgaatagctctagtttactttgagtatttaggacataactaaattaccgttttcagtttgaaaatggcgttacaaaaactacaatagaagattttcacattaaatgattttacatgaaagtgataggctctactttaacacttactttctattttagctatggatcgcaatggccttttcctcaaagtaatcgtaatgctttggtttgaaggaagcctgctatttgacgaggaactacaagctctgtagttccttgccagaattttgttgctcataagcaaatttggcttttaatgtgttctctttagaacatttactatttgccatgaattcaaacacttgctttcagcaaaccaactattttgatactgcagtgaaaaggaggactgcatactctttgttcatagtttcagtaaatcagctaatctgaaggtagctattcccttttgatggcttctgagattatttgtatatagtcaagaagcagatgtatgtaaaattgttaatccacaaagattttatttccaagaatgaagataaaaacattaatgcatgcctggggcaggttgagttctctctacgttaaagaaagtgtatatatatgtatatatatatatctgtttaaaatatatttggcctatggggctgaggctatataaaagtctccattgataactcagatctcagagtgtctgcgaaagtacaaaagtataaataattctccctgtattgaaacacatccagaattaaacaatatattcttgcaaaaggcaattaaaagttttcaaggaatggagtgtgtcatttaagtttggttcagatgttcagttagcaaatagtgagaattgcagagctttttcattttgtggaccttagtttctttccaggcatctgtgcacactggaattaaaatgcatggaaattttttttttttcttgacaaagcatcttttgcttattttctgttctattggagatttttctgacagcctgttgccaatgatgttctgtgttgcacgtaggattttacctaatgaaaccaaggcataaattatatcaaaagactagtacaaggttatctatttttttaaatgcctttccatgcagtccttactacattatatctgtcactatacacttcttccggaacagctgtctcaagaacttctatggagtttttccagactgttgagataaactagtttcctagaaaatcagagttatgtgtttcaagactctcttgaggggtccttattctgctttccagtaggtcacttaaaacgaattgaattgaactagatctttttacaaagatgctgcatctcccagataatagttacaatgtcaggtcaagaagaataccaatataaatagtgctagacatactcttgctaaacttcctagagtagcttttcccttttaagtgattttctggataaagctcacaacaaatacgttattgataaatttccttataaataacatcatggaggttattcatcaaggatgaaaatcttcaagaaagagaattcagaggccatgattctaagagatagctgctgaaatcttaccaatagaaattgtccaacaccttggtgaccattatagttaattattgcagtaagatattaattattattacattttatgtgcacatcatttaatgtatcttggcaagatgacccttaaacatgaatattttaattactttatttgccatttgggtaaaaatatgggatgggcatttaaagccagatgttgcctcataaacctcacatttaaaaattaagtattctcttctttgtgaacagcttcacttaggggatggttaggccttttctcaaggatccatggaataaaagacgaagtatgtttaaggaatataaatggatgaaaccaccaaaacatttattgcatcatgggaaatttttggagaccagaattgttgattccaaattatctgtaagatcattctgtagacttcagatagtcctgaaataagattctgtgtgtttctctttatcttccctgaccatcctcatttgcaatgagatggtgaattaaggcgcatctgtggtctgatgagttctgagcaagccctgtatggaggtaagcaccttgaaagggatataagcattcttcatagtgcaggaggcaatcatcaactgtgatgaaatgtggctttgtattcatctgcctctctttccctgcccttctcccatgatgtttattcttttttggagtatcagtgcccaaacgctcttccttgattgatcaaattcaaattcttgtttttatgtatcacccatgatttgagccctctcccctctaaaattcaaaggaacccttctgtctcaaaccattggataagcagaatcttcctagtgatgtcattttaaagagagtttattagcacagataaatctctgctgtgtagaccatttaaatgcagactgtattttttaaaaggtaattatttcgtagttctgttctgacttgtgattgctactgtcaaacactgtttcagaagaggagcttctgggatatctgcttctgaaagtttgcttaccaatgtcttggcataaagtcatggagcaggttttgaaagaatgcttcctgaggttttcccctttctaacatcagaaactgtctccttagaacattagattctgttataaaacaaagtcatcattttaaatagagatcagtggtgcataataaagtagttctgataagctgagcatggtcaggaaaaaactgccctgtatgttgtattttgtaataataaagcacaagggctttttaataaaattgtagatacctgaatacccgtgtgttagattgagggatggaacattaggataagaagaataaagatgttttgaaggatatggacttgaagaagtgtaaaagatggttatgtgttatccataaaggactaaataataacaaccaatgttagagaaaggtgtggccttatttttttttttttcctgctcgctatgatttttctattttttgtcattctgaattgaaggtcaaaaatttgatccacgtaaaacataatacaaatttatcacaggcaagtactctgcaaagttgttgtttataaataatgcggcaaggacttcaaaacatttaaagcaattattccttttaaagtgtatcatagagaagatttttagcattttataagagacagaactggatttccaccttatgtctagttaagtacatttgtgaatacttttctcatgcttttatctgacaatgagagtggttctgtttctgaccttggtaatgtggtaggttaaaagcagtgcaagtttcatatttaagggtggaaaaaaaatcatgagttggtaatgcatgaaaactggaaattaaaagatctttggaatcctcaattaacattacatgtaatttagttttgcattttgtagatgccaggaaaatatcaggaatgctggtcatttatatttctgaccagtccttcatctctcctaaattcagacacagcatgatgaatgttagactattttattttaattttatagaacttgtttgtacttcattgtgtagtatttggtgacaattcataattttgacaaggtaggagaatcgtatcagagaaacttgactgaacataactattaatgtctattaaaatgcatctatggaacatagtattaacacacaattaatgcaaaaccactaatttttctcacataacctaaggcagaatttctcaacctcaggactattgacattttggatcagacagttctttgaagtggaagggcggggggcgctgtcctgtgcaatgtaggattttagcagcgtccttggcctctctctacatagtaaatgccagtaagcaatccctcctcaagtcatgacaataaaaaatgtcaccagatatcatcagatgtctcctgaggggcaaaatcacccggggttgaaaaccactgatctaaggttttactttaatgcagatatctagttgaatctgcatagtaaattgacccatgatacatgtttccgtggccagtggtgtccaattctggctgattctcataatcctgatgtggtgtttgcattttgctaaagttttgtcacatcagtgagttttattcattaattcccaataacgaatatgctattaaaacaggtaaattgggtagttcaaattattttctaaattaagctgttaaatttagtgcttggtaaagcaggaagtgtaattatgtaatgtacagtcaaatgtccaggggtaaatttcccttgttcctggagatctgtgaatttcctgaaggaaaattttgcagtgaaacatgtctttagcagaaaggtactagtgtctgttctttcctgctgggtctggagcggaaattaggctatctatcctgcccatgtgcatagtgcataaaatgctttgtagatatcaggaaggctggacagttgccagggtggcctgtgggcaagctgtaattaacatggacacacactcttgctaagggtatttgtttcacctgggaaagctgcatagtaaactaatgaagatttttttttcttggctgaaagtgcttggcttttttcagagaggtacaattacagagaccccaaaacagtaaaattactttggggacaggctcatgacagtgtgacgctttacttttaggcatgtaatgtttagtctttttttttttttttgagatggagtcttgctctgtcaccctggttggagtgcagtggcgcgagctcggctcactgcaagctccgcctctcgggttcacgccattctcctgcctcagcctcccaagtagctgggactacaggtgcccgccaccgcgcccagctaattttttttttgtatttttagtagagacggggtttcaccgtgatctcgatctcctgacctcgtgatccgcctgcctcggcctcccaaagtgctgggattacaggcgtgagccaccgtgcccagcctaatgtttagtcttatatgtggctctgaaattttatagggctggcctgaactctgatacaccaaaaacatcttggtgagtatgaaaagaataccaggtgtttctgttggtctactttttctgtaaatggataatgcttgttgtcttataggacagtgcacttacaagaatgacaccacaaagtggtgtattatagaaacagaaatcccagtggtcactgtctacattggtgaggagggaatgctattacatgagggaaaatggaagcccagaatctctgttactttatttatttatttatttttgctttattctatcaaaaagtaatatcttttgctttattctatcaaaaagtagtatctctgcttctttttcttctttctacaaagaagaaataatacaatatttaacttctttagttgattggcattaatgaggctcttaaatatttcagatgcattctactcttattgtctaatatggtttggctgtgtccccacccaaatctcatcttgaattgtagttcccataatccccatgtgttgtggtaggggggaccaggtggagataattgaatcagggggctggtttctcccatcctattctaatgatactcagttcgttctcatgagatttgatggttttataaggaacttcctcctttgctgggcactcatttctctctcctgctgccatgtgaagaaggatgtgtttgattccatttccaccatgattgtaagttttctgaggcctcctggccctgtggaactgtgagttaattaaacctctttcctttataaattacccagtcctgggcagttctttatagcagcttgagaacagtctaatacattgtcttaggaaagactagaaagactcatgttgatgtggttagtgtctccttttaatattgtcctctccataatactttttttgtatgtcattttatttacaaaacgtaaatatgttacattctcactatatgcaaaatctaatgcatttttcacacactgatctccccctttttataggtactcaatatttataaatgggcagaaggatctttgcctttacctttcctactacagacaaatttggtaaacgtgtattctatacctactatcattttatttgaattcggctcttcccctttgtttactgtcatgttggatgtgaggggcaaaatcaccctgggttgaaaaccactgatctaaggttttactttaatgcagatatctagttgaatctgcatagtaaattgacccatgatacatgtttccgtggccagtggtgtccaattctggctgattctcataatcctgatgtggtgtttgcattttgctaaagttttgtcacatcagtgagttttattcattaattcctgataacgagtatgctattaaaacaggtaaattgggtagttcaaattattttctaaattaagctgttaaatttagtgcttggtaaagcaggaagtgtaattatgtaatgtacagtcaaatgtccaggggtaaatttcccttgttcctggagatctgtgaatcctctggtttttgcctgtagtctagcctaattgttaatagtgccctttcactctcaaaactgttcaggtcagacaacagattttgtggtggccctatgctgaggctatctcactaatacatctgccatatggtgtgatctttaggaaatttggattatatattactaatgtgtatatgtaacatgtagtgaaactatatatttatcaacttctatacatatatgtagattgtagatgtattaacttgaataaaccacaatgactgagaaacacttcttgcctcttcatatgctggatcactctttcctttacgtgcattaagaaatgggataattactatgtattatattccacaatagcagtttaagagttttaaacagctgtaagtagccaagttatgcaaaccgttaatatcaagaacaatcctaatttaggcattacatatgagactgctgtcgagtacccacatgggttgacttgtgctcccccaaaattcctgtgttgaatttctaacccccagtacttcagaatgtgaccttattttgaaattgggtctttgcagatgtaactagttaggatcagatcatattagagtagggtgggcccttaattcaatatgatgcatgtccttataaaaaggaagaatttggacacagacatgtacacaggatcattgctataaatagagagtgcatgtgaaggctggagttatgctgccatacaccaaagaattactagtagcaaggggagagaacttgaacagatcttccctgagagctctcagagggagtatgaccctgccgacaccttaatttcagacttctagtgtcctgaaccctgagacaatacatttatgttgttttaagccacctggttgacaatagtttgttatggtagcctgagcaaacgaatccagacatcattaccttctttttgctgctctgttgggatgctcatgacatcactattcagtcatttaaggactggtggagcatactgtcatataccacaattattacaatgattacattttaaatgagatttttaaattctttattattattattattattattttttgagacagagtctcgcgctgttacccatgttggagtgcagtggcacgatctcagctaactgcaacctctgcctcccaggttgaagtgattctcctacttcaccctcccgagtagctgggattacaggtgcccgccatcacgaccagctaatttttgtatttttagtagagatgaggtttcaccatgttggtcagactggtcttgaattcttgacctcaagcaatccacccgtcttggcctcccaaagagctgggattacaggtgtgagccacctcacacctgtaattctaaaggaattctaaaataattcctttatttagtattcaatctttcctgtgtttggattccaaaatatgatcttttactggctatgtgtacacatactgatctacacacactgattcatccatcttgcttttcttctgggcatttttttctcttataagaaaatatacattaattaaattaagattaatctaaatctaaagcagtaagcctgattaaagaaaaaaaaaagatgcagtgcattaagctaaagacaaaattcaaagtcttatgtggcacacagcctatgactgggtaagagtcatacataacctacctgaccagagcgagaatacatgcaatgttgcctgtttattaggtcctacagaccaaaatttcagggtttttttttgtttttttttagatggagtttcactcttgtcgcccaggctagagtgcagtggcgtgatctcagctcattgcaatgcctcctgggttcaagtgattctcctgccccagcctcccaagtagcagggaccacaggcacccaccaccatgcccagctaatttttgtgtttttagtagagacggggtttcatcatgttggccaggctggtctggaactcctgacctcaggtgatccgcccatctcggcctcccaaagtgctgggattacagatgtgagccaccatgccaggccattttcaggtatttttatgcaacttgcagacttcatgcctagggattttttctagcattcttggacaaagagatttgtatctgatgtgtcttcctgtactcttctgtggtgcaaccacaggggatctgctccaggtttggaaaatgtgtaatgggtgaataggataattcttgtcagacagatttcccaagaaataaagagaaacgttaggcttttaaagacttgtttaataaaaaagggagctaatttagaaagttgtttttcttcttcccctaaataaggtaatgtgagaatagttccttctattttgggacattttaagttaagataatatgaatttgttaatatgtgcattgtcagaatgataatgatgtgattataagtatgaatgagtagctataaccagtgcactaaacagtcaattttacggaggtgtccacttctagggtgtatggacatgtagaatcaaagtccaggctcactttgagctgttagtgctggctgttgagtgttaagttcaacttcttgaagaagatatttttacaataaacattctggacacatacacctccttcgaatggatcagaatcacttgtagcctgaatcaatgtggtgtgccttctctttcaggacttgacactatgtttaccctggcctccctggatggaatgctctatacatgcttttaatactcactgctgctcttgcttcccacaaattagtatgcaatagattattgtccatagttaggtttagtaggtcttcccactatttatttctttcgccacgtttgtttcatgtttccttaaccacttctgtaatatgtgtgtggggtcagatgtgattgtggcatttcatactagccaggggtccttgggtacagcaataaacatctctgagtctctattcctcatcagtaaaatgcattcaaattcactctcttctctagcaccatgtgttgttgtgactttcaaatgaggcaatgtatatgtgaatactttgaagactgtagagcacaatgtttacatgtgatatcaggctattcatctttttcagtaagccatcatcttggaatttataccattaatcttgcctttaggttggtgaatgggctgcttgaggactgctttttctgagctcatcttgtaattgaaatgaagtttggacatcattagaagtgatgaagtgcagacaccagtaattgcatgctatgattttgctacataaatagcctccaggtttatttgttgaccaactaaataaaattttgactgtattattattacatctcagattattattctagtacttcattagttaaacttttattcaggatagtatatcattaataaaataattcatggtatattttcattttatatatatattacattctgtattagtgagtatatatgtgtgtatatattaatcaaataatttaataagcatttcccatcatagttcaagcagtatttagtctctgaagaaacaaagccaatagaacaagattgtttcttagatcacttataggctcattttaacaataattaacacattaagtatttacatctaccaccttaaaagctttatatttttcctaaattactttgtctttacaaaggatttgactgcaattaagactcattgtttataatggagctgtttgggaaagaatggtaatatctcaacaaatgtttttctgccaagtatgaataatagaacaagtccatttattttcctaaggaatgatggggcttgagagccaaacccaatgtcagccattgtcctggggctccccagggagatgtgggtcatgagagtgaagctctgcagccaggcagaggtgggaagactctgaagaggcacttcacagccctggcctgaaaatgcagacacaacaattctttggcagagaaaccagggcatgagtagaaataaacttgctgataacccattttccttgggtaaatgttaaatattagagatgaaaaattaataaattaatatgaagtttcttttgcacagatataaaaattgttcctcagacaaaatataaaagattaaaagcgattgactaagaaatgttcaattacgaactacttggagatgttatatgagaaatactgaggtagtcttatcaaaatctgttcgacatgaaaacatagaaataatatatagatatgggactaattcaaataatagtacttctctaatttttaagattaaattattacagttaagagaatttagcaaactaaatacttttaacaaactgttaatgcttatttgaatggcttataaacactttagagctttctccttttgtcatttgagaaaaataacgggaaatgtttctgttattaattctgaattaattctgaatttaacaaaatgttttgataatttcaagggagatgtataatgttcactctaaatagactttttgaatatcaagtactttttaacatagatttctgcataattttcaccacttagaccaagaattgatgattttctgatcagatcgtgatattttctgattagaaaatcatcaattcttggtatatctttcagaaataaactgagcagttaccaagagactaacaaatgatttccacattctttgagaaccaaatcagaggaaatggtttaaatagttacaagcactaggccgggcacagtggctcacgcctgtaatcccagaactttgggaggctgaggcgggcagattacttgaggtcaggagttcgagaccagcctgaccagcatgctgaaaccgcatctctactaaacatacaaaaaattagatgggctagtggcccgtgcctgtaatctcagctactcgggagtctgaaggaggagaatcgcttgaaccctggaggcaaaggttgcagtgagctgaggttgtgtctttgcactccagcctgggtgacaaagcaaggctgtgtctcaaaaaaaaaaaaaaaaaaaagttacaagcactgatagctttgaacacagttacaaatatgtaagtgaagccctgaacagtttttggaagactgatcaaagtgtctagatacaaatacatgtgagatatggcctgttttttgtgtttttaatgcacagataacattgtatatatttattatgtacctgatgttttgaagtatatatacaggcctggtgtcttgatcaaagtttatatttaaaaatgacttgtcatgtgtttggtgacacctatgtggatggcagctcagcagcaccatttgagatttaggtaaagtggtaatgattaactatgaaagagggttttttggggatttgcaaatccagataatggggagtgtgtgtgtgtgtgtgtgtgtgtgtgtgtgagatttagttttcgtttggcttgaggtaaggagtttaacatcctgaggtactctgaattgctgtgaattttttttttacttctcagcaaatttagacatgtcctgtgcatgcctattgcgagaaatgccttaaaatgcagaagtgtctccagtgaagactgctactcaggaaaaattccccaagatattttctacttctagttcttctgctccatataccagaaagaatgggaagaggcaaggtgtccgcatacctgtatggagaataggctttgaggttttagattcttggatgtacatataggtgcttattttaaaatgtcagcaatatattttaaataatattacttctttatcttttgaatcatcagctgtttatttggttaacaatttgttgttagcaataataataattggtgtcatctattgagtactagataccaagcagtatggtagtgttttgcttatattatttaattctggtctcaattctataaaacagggaaatatgttattttcgtttttataaatgaagacactgaagtattgagcagttaataaatcacctgttctggactatatagacagtaatagtggggcagggctataactcaggtctatctgatttcaaactttctctcaaccactacattgcattcccctctcacgcagagctgctcaggcaccagattatttaaaataacatttataataaatatggccttacttggagggccattaaaagatgttgctaacaagttcatactttcactttctctaggctagtgattgttacctggaagacactctctagataaaggaatggcttttaaaactcttgcttctctcaaagaatatataaagtattaaaggaataaacattttgttttccagaataatacatgtgaaaaaatatcttcaaagtgaaataggcaaatgaatatcaaagaagcttattttagaatgtaatcctatgagagagagggcagtctcgaaagattaaaaaagattccttttatgattatgaatttgaaacagctggaatgaatgcagtcatgaggatcatttctgaaagtgagggatatagaaagttaaaagactcatcgcttggtactgagatcacctgcttcgtaacagacagaaatagaagagtacaagtgttaagaattcattctgccttccccgtgcttttgtcgctttatttttagagctctgctagcagcagttgggagcaggatttgcccttacgcgcctgctcagtcagactcgccttctctcttgcagtctgcctcccttgacaggtgtgagggacttcctaagtgtcgcaagccagccacctggcatcagccacccctgatgtagcgtgcaccttcagaccactgagctcatgaaagaggtaatttttctactgcctgttaacatgcgttagttttttcttaaggctaagccaatcagaatgaaagatgttggatagatagcagtacagaagtgataaacaatatttaataaaaatggattaggtaaaccgctatgatggattgattcataaggaaaggatgaaaaggtatattttagggcctcccctacacaacctaagcagatattgtaaaagtctcaaatcacacaaacataccttttcttgtaataaagtagagcatctttttttctactaaaattctgcatgtgtgtttatgtttctgaagaaactagaggaactattacttagaggtttatctaaagcatgctactcaggagaaaagtaagtgtaatagtttaagatgcacggtttcaaatacatgcaccaaataatgacattttattcaatgatgggccccatatatggcagtggtcccatgagattataatactttatttttctgtagctttctatgttgacatatgtttaaatatacagacacttatcattatgttacagttgcctacagtattcagtaccgtagcgtgttgtttgtagcctaggagcagtaggctataccatacaacttagatgtgtagtaggctatgctatctaggtttgtataagtacactctatgatatttgcacaatgacaaaatcgcctaacaatgcatatctcagaatgtatccctatcattaagtgttgcatgactgtatttaaaacccagaaaacgatagtgtgcgaaagagaccttaggcaatgattttctcaggaactctcagcaatcacattgtacattggaattacgagaggtacagtggctttataccacagatacacatttgaatcgcctggggaatttaaaaaagttaccagcgccttggccctaccctagagatgaggataattggcctggcattggtatttttaagaatttacccagatgattttagtgtgtagccaaagttgagaatcactgaataggagaacctaacagtaactagtttctgcttttgccaatacttgcatcatgttgggtaccacactttatttcttcatatttcagtttcctgtattaagaggctaccagaagaaatagacctttaaaaaattggggaactctgtaaggtgcattcagaattatttacatccacatatatttggcttgcatgacttgcagaaaaaacattttaaaatgtactaacataattgaaaaaaagtcacaagactttcagtatctgataatctacaagtaatagtcactcaaatgttggttgaatacctactatatagaaggcactggaaagactatggattttggccttttatttgttctcaagtaattacaagctggggaacttatagatatagccaaagaaataattaatatttcaaagctgtgtgtgcctcacagctaggtacaatagttcaataatgaatgcaaaaaaaaaaagagtgacaactctgggctcatgaggtcacagagccttcacagaagctatgacatttatgaagttaaccgtgttgttggtttgccatcctccccatcacgtcttttctcttaaagctttagtatctttgaagctttgttggtagcttaaaattgccttaaattgtcttctctgtgtacataaaatttcttgggaccatctgtaattagttgactacgctgtgtttacaactgcctggtacctgaatacggtgcttatgtaaaatggtagctttcaatttgacttacagaatggaataggatttaggcccaagtacaatagggtggattttccagtccaaggttagaaggaagaaaacactaaacaaaagtagaaagtatacaacttgattgaaaaaagagagaaagttatctcaacagtatcagagtacatgtccaggatctgttctgtgccgtatgtgctaagtgtatctttattattatgtttacaacttcccccaggtattaattacctttatttagtaaaaagagaggttcaaagagtttcatatattcagatgtcatacaaagtatcatacattagtaagtcaggtttcgtgtactgtcccagcagccattctggtctcaaaagcattgttcttctcactctgctgtgctgccttgtgtaaagggatatgagaggagataaaaagaaagtaaaaggaaaggccaggcactgagtcacatacctgtaatcccagcagtttgggaggccgagatggcagaccacttgaggtcaggagttcgagaccaacctggcgaatatggtgaaaccccgcctctactaaaaataaaaaaaaattagctgggcatggtggtgggtgcctgtaatcccagctactcagaaggctgaggcacaagaattgcttgaacctgggaggcggaggttgcagtgagccaagatcatgccactgcactccagcctgggcaacaaagtgagactcagtctcaaaaaaaaaaaaaaaagaaagtacaagccgggttgtgtagtccttttaatgcaaagaatatattttattctgatggaagttgggagccattgaagattattgaaggaggaatatcttctaggtattttagaagataatctatcagggatagatgggctatatctattaggcatagaatccctaatctatcagggatagatgggctatatcagttcaatagaaatgattatttgttcaaaaatgatttattgaacaaatactatgttctacagtgtctagtccccaggaatagagttgcattaattaacacttatccagagaactcttatttaatacactatagtatgtaaagtgcagatgctgtgtcttatttatctttctcccacctaaattgtctaaaaataataatttttgcaattttccaactgtatgtcaatgctgttgttactaataaattgtatttggaaatcttcatgaatttataatagcataaattggtatcattgttaaaaggaatcttcattcaaaaattttagcaagcattgctcttactagacatttttgtgaccaatgtgcagaccatcaagaaaaaaatcaattaataaataacagtagtagtctttcaatatttgagagatagaggattacattttatagaagtaaagaaatattatgagtcatttggtgtactcatatcttactttgcttatttagtgatatgagaagctctaacccaaggaaagatattcaaatatggttgtcaaattcattttctacttcctctttggatttcaaatgcattttcatagtctagcaaagtgagctcacacaccttatatgtgtgctctctggtaagcagatgtcacagaattcacttgagcagagttgaagacacctgtcaggcagttgttaatttgagccgtgctgcaactctttgtctatatcaatcacattctttggtgggacagaaaactgtcattaacagatctgccagtaaggcctctttatcatatttatagaggggtagtaagtagggtaattaattgttatgatagtgtttatatatgtggacctatcatatgaaattactaaaacatacattgattcattatagttattgaatatttattttttgggaggaattatctggataaagttgaaaagaaagtggaaagcataaaattaacaaattaatgagacaaaaaaattctaagattgaaacagataaagacttgtccccaaaactaatatccagaatctacaaagaacttaaacaagaaaaactgacaagaaaaaatcaacccgatcaaaaagtgggtgaaggatatgaacagacacttctcaaaagaagacatttatgcagccaacagacacatgaaaaaatgctcatcatcactggccattaaagaaatgcaaatcaaaaccacaatgagataccatctcacaccagttagaatggcaatcattaaaaagtcagcaaacaacaggtactggagaggatgtggagaaataggaacacttttgcactgttggtgggactgtaaactagttcaaccattgtggaagacagtgtggcgattcctcagggatctagaactagaaatgccatttgacccagccatcccattactgggtatatacccaaaggattataaatcatgctgctataaagacacatgcacatgtatgtttattgtggcactattcacaatagcaaagtcttggaaccaacccaaatgtccatcagtgatagactggattaagaaaatgtggcacatatacaccatggaatactatgcagccataaaaaatgatgagttcatgtcctactttgtagggacatggatgaagctggaaaccatcattctgagcaaactattgcaaggacagaaaaccaaacaccgcatgttctcactcataggtgggagttgaacagtgagaacacttggacacagggtggggaataccacacaccggggcctgtcgtagggttgggggagggggagggatagcattaggagatacacctaatgttaaatgacgagttaatgggtgcagcacaccaacatggcacgtggatacatatgtaacaaacctgcacgttgtgcgcaggtaccctagaacttaaagtatatatataaaaaaagatttgtcccccaaaagcagtaaaatgaacaccaaagctatgatttctgagccagggctcctcaaaaatacattcttttctttttgtatgtagcacaggcatctaaactataaacccaaagtggaaagagtgaggatgtgacacactttgatgatgggttggagaatgtattccaccagacaccactcaaactataatccccacacttgaaaagtagttccaattgtacagtcatgataatttgcatttttttaatatgtaagtacatatattatgtatacttgtcattcctcggaatctccttctaactttcacagatgcatttctgttaatcattcagccacagtatgatttcctagactttgtcattcattttcctactcagtagcctcctgtaagatcagtgttaatttttcccagggatgttgcaatgtctttacttagaagtaaagtaatttctcccagatttgtaagtgtgatcccattggtataaatttagctcatttgaatgccttaatttagttagatatctacatttttaaaccttaattttatgtccttttattagtaaaagaccattctaaggctattaacagatttgatacatacatttaaaaagaaagtgtgttaaccatctatttttttatgttactactattgtctaattaggcatacatcttcacttgtaaattgagagcatttattgtcctccattactgagcatgttttgtgtccagaaatcccaagaacagtgacttctaaatgagtaattagataattttaaaaatgataaagagaatatcagtattatttgctaactcattttacctcaacaaaagttatcatagtaccaaaaaagttgtatttaaccatttttgaaacattctagctcaatgagaataactctcaaaatgagctaaatcaggaaagtgtcttacatgctttagattctgctattcaaactctacgcactgtcccaagtaaatataaatttagtacttgaatgacagcaacaaatgctgaaacctaaccctaaattcttagtactctaatgggccatatttggcaaatcacttctctctctcgactcactgatccagcaaatatcttttttgttgactacagagtgacactgcatgagacacagggtacagttttatgattttcttttctgcagttgtaaaattaatagtattgactggggtctgaaataatgagttagttttaaaaagttaccaaatggtgccaagtgtggaattagagttttgctttaaacaaaattctttaatgcattacaaaaacaagtgtgcaagaaatgtaactaaatttattcccccacagttgagcttcatttcaaccttgaccccttcttaaccatctcagaagaaaacttaagctagttaacaattcacctaaactcatttaaggattcttccctaacttatttgaaccaggggtgtcaattaagatctggggaaggcctaaacagttccaggcttcggaaagaaagggttcatctagcatcctttgaaatgaagccaatctgttctgacctttgtccctactacagatccctcgctctccatgttcctgccgtgccctcttggatgcacatgtcactctgtgtcctcattgcaaccagaagtttcctgcaggtgatagggctttatcggctctttccctgtctttcttttggctccagagtttccagaacttatttagaactcccatccaagattttgactctttggtctgtgttccttggtgtcgtcctttggctactgagttgctgtagagattggggtgagaggcagatagaggaagaggaaagtgaattcttagttaacactgctagattttcttcgttcacatttatgaaaactattcactacttacattttaaatatagtttctcatatagcctgaatatttactttgtcattacctctggtaaggaagtgtagttggatttggatgatattggaagctcaatcctaaaaagtttgtccattgtagaaaaatacttttgtctttcagatgtgacttcataaaaacttcatcctgctacgtagtggaacaattagccactgtcagccttggaaggagattgaggaggacactgggattgcttccccagcattaattccggtcttcccccatgatgtagtatccatatagtttggggtaggggtgctgattccatgttaatcagtgaaatctcttcaaccttgacagtggtgggtgtgacacccaagtgcttctagaaagatgcctagcactattgttcagtaagtagcaaagagaatatttcttttctgggttttgtgggatgcagatataaaattggggattgctacatgattttgctaccctaagtgaaaccatgatgacatgatacaaggaagaagacaagttgagaacaattggagagaaagagaactggagtcctaactaaactacacttgaaagtccaccttacttttagagactttacaaccgaccaaaaagagtttacattacttgtataagcaatttgagttttttgtcttttgctaccaaaaaaattctaactaatacaaagatatacttgctaacaattctcaaatgtattacctccaaaatctttctctaatcagtctggtcatcatttcaggcccactgggtttcttgacttcagtatcaccaagatgtatttaagaagttcaaacttagacccctttttatctccgtcctctcttctcccagtcttctccccttacctttcttttctttgctaatagtgtcaccctctagatattctaagttagaacatttagaattcgctgaatactcccctttttatgcccttccattccccttccacccaaatttagttggctaccaggtttttcttatcctacttttaatttttccactgttactggctaaggtcaagcctttgccacattttaactaaattatagcctttcgttattataaataataatctattatcattctgcctcccaaccccaatgatctgttctccacactacagtctacaatttaaaaaaacccgtaacttctgatcatgtcccctctttattttaaaacattcagttgacttgtttaaaggataatattcaaactctttaacctcaacctattttacttcttcttctttttttttttttttttttttttttttgagacagagtcttgctgtattgccctggctgaagtgcagtgatctgggctcactgcaacctccgcctcctgggttcaagcgattctcctgcctcagcctcccgaatagctgggactacaggcacccgccatcacgtctggctaatttttgtatttttagtagagatggggtttcaccatgttagccaggatggtctcgatctcctgatcttgtgatccacctgcctcagcctcccaaagtgctgggattacaggcatgggccactgcacctggcccacttcaacagattttttcaagtctctccttctatcttcattctggtcttgctcttattttaaaaataggaataatattaataagcccacagatttattgtgagggttaataaagatgatgtgtgaaagtatctggaacatggtacgttctgaattttatggtaattgctactatctgctgataaatagcaattatttgccaaatgctgcctctctgactttgcatatgctgttcctttgcctattctttcccagcctccttgtgaatgtcatcttctctttcagaattcagatgatttcttccctctgtgatttctccagcaatcaatagctctatcatgtaatcttcacattttgtcaatcagttagtagcatttatcacatcgtattgccatagtttttaggaaaagatagcctttctttactgagttctgtgaaaaaagaaactaaaccctgtctacctctctaaaattacaactctgctttcgcgctttctatcccatttcccaattttattttttttcttatgcatgtaaatactaaacactatatggtttacctatttgtcacattttctgtcttccccattaaaatgtgtgttttactaggatggaaacttttgcctttttattcactgatgtagttccagtctctagaagtcagcattttgagggaataaatgaatgtcttatttatcttttcatttctttttttttcttttattattatacttcaagttttagggtacatatgcacattgtgcaggttagttacatatgtatacatgtgccacgctggtgcgctgcacccactaactcgtcatctagcattaggtatatctcctaatgctatccctcccccctcccctcaccccacaacagtctccagagtgtgatgttccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgctgcaataaacatacgtgtacatgtgtctttatagcagcatgatttatagtcctttgggtatatacccagtaatgggatggcttcgtcaaatggtatttctagttctagatccctgaggaatcgccacactgacttccacaatggttgaactagtttacagtcccaccaacagtgtaaaagtgttactatttctccacatcctctccagcacctgttgtttcctgactttttaacgattgccattctaactggtgtgagatggtatctcattgtggttttgatttgcatttctctgacggccagtgatgatgagcattttttcatgtgttttttggcttcataaatgtcttcttttgagaagtgtctgttcatgtccttcacccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttaggcatgaagtccttgcccatgcctgtgtcctgaatggtattgcctaggttttcttctagggtttttatggttttaggtctaacgtttaagtctttaatccatcttgaattgatttttgtataaggtgtaaggaagggatccagttttagctttctacatatggctagccagttttcccagcaccatttattaaatagggaatcgtttccccattgcttgtttttaatccaacttacaagggatgtgaaggacctcttcaaggagaactacaaatcactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgccttgcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatcttatctttttatttctaatgcctaatggagtagcttgcctgtggtaggtgctaaacaaatttggctgaataaatgaatgtgtgatgctacaaacctggaaatctggaagaatttgaattagcgacttaaatgtagaagatttcctattatagtttaggcacctttaatgtagtgaaggtaggggtcagttgcagtgatgtctcccaagtgccccattttgaactgtttagttttttttctgggatggaaggtataaaattgaaagaacgaaggtgtgtgtatggggtgggggtgggggctgggggggtggggagtgggagggagatggaatcttctaattagtttttatctgtttataaaaaggaagtgatttaaaactgtaaatacaagattcgccagtctccctgtctgcttgtttataaatgggaaatgtaaacgatgtttcatcattgttttatcattgttaagaactttttttctaaattgttttactatcttgtgaaaatagttgaatttctacatagctatttaaaacagagtttttttgtttttttttttgagatggagtcttgctctgttgtccaggctggagtgcagtggagcgatctcggctcactgcagcctccgcctcctgggttcaagtgattctcctgcctgagcctctcgagtagctgggattacagtcatcccccaccacgcctggctaattttcgtattttttgtagagacagggttttgtcatgtggaccaggctggtcttgagctcttgacctcaggcgatgcgcccaccttggcctcccaataaaacagagtttttgctaagttacaatacagaaatagaattgagtggaaacaagagttccttttagtgctgactctgatttttatgagactttaaacttcatctcatactaatcacaaaccagccagattttggtgagtgtgttgatctactttgaattggtgattcaaatgtagaaggttctctgttcccttataaaaatcacctcagcttataattaaaagaaagaatgaaagagtaaaaggaatatcaaaaggaaagaaggatggaaggaaggaaagaagggtagaaggaaggaaaaaaaaaggggagaatggggccgggtgtggtggctcatgcctgtaatcctagcactttaggagggtgaggcaggagaatctcttgaggtcaggaatttgacaccagcctaggcaacatgttgagaccaccatctctacaaaaaattttaaaaaatagccagcatggtggtgcacgcctgtagtcccagctactcgggaggctgaagtgggagggcccctttagcaaaggggtttgaggctgcagtgagctatgattatgccattgcacttcagcctggacaactgagcaagaccctatctgaaaaaaaaaaaaaggagaaagaaaagaaactgaagtggtagtgtagtgagacctcgctcagaaatgaacaaagcatctgtaaactgatacttattttttgttgtgtgtaacaacagcatttcaattctgtggatatgttagtgtgagtatacacatacacacatatgtatttactcaccacataattaagaatttcaaagataaaactcattcttttttctgatttgagaattctgttgctacacattcctgaatggaatgatgtttgtcttcactgtggcaaagactgttaaattatagggagtagtaaagttgttgatttgctgcaataaaaatcatgaagaaattgagatctttctcttccagctgtgttctttcttccttacttttttagtctctcccctaaatgttaggactggggctctaaggctattgagcccttccttctttaatagttgtagtttaatcttagcatcatacagtctaaatgtttaaggagtgacttcatctttagatattcagacgaaagagtagttggacatagcctgtctatgaagcctcattcttagccactctcttcatctatctaatcctatcccactggtatctctcaccaggttcttaatatactcatgactgttgggtgttggccattctgttccagcacccagtttgctcttttccccttttattgtctaataagagccatttagtctttcagagttttatctagtaagttttatctaataagcagtgtgaatgttgactctgctacggtgttagctctgttttttggcctctctgtgtctcatgattataacagcgcctatcacagagcatggtaacgatgattaaatgggtcatatgtgcttagcacattcgttaatatggcaatatatgctcaatacatttggctgtcagaaggaatcagttgctactttctatactgatattgctccttgtgcagatacctcatgaaaatccttattgcattatattttaatcactgatttgcctttgtatttcttcactgttttgtgtactctgtcagcatagacttctgtatttttaaatgctcaattctaggcaaaatgaatattgttaagaataatcacttgcaatataaaaatactttcataaacacaaatatatgttagataagtatattcaaagaaaaaaaacgaaggaccaaaagaatgtcagaagaataaagagctaagagaagactgaaatataccaagtataggtatattaaaataaaaatatatttttagattcatataagaatattcaatttttttattttaagtacaaatacaatgatacaggttataagtacaaatacaatgatacaggttatacatgtgagggcagggagcttgttagttggagaaagaccaagtactgatgataaacaaaagccagaatccttttggggaaagcgagttagtgatgaaagcctcctggattttggttccaagaccaaatgattttggttggtactcggtgtggaatggaggtggggtggggaggaccatgcaacttttatgaaaaacctagaaacaggtgaaagacatgaagaaatcaatgcataagttcaaaaagaaacgcatttcaattcacagtgtcagaaattggttggaaagatgtgactggactttaatctctagtttggaattctgttagacttttgttttcagttaaggaatatgaatggaaaggaaccttagttcttttcaatgaggaggtagcaaacttttgtgtctacatatacttgatttcttccatgcttattatgttgccaatgtgggtccagacactttaatattttgagtagtaatttaggccttggtttcattatagttagatttccttcattatttggatataagaagtagaaggactactgccaggaaagtcaagcttcaagataataatgagcttcatgtaaaagggtacagacagtgaatagaagtgaggggcagtattacaaattgagcaatagctatttagacgtaaagaagtagctagtacaaggagtccctagggcagacatatattgtgtagccacagagtggtgaattaaccttgacagatactagtattaagaaaccttaggtgatttaagactatccaaatattctccttcatttttaaagagccagattatggaactatatgattatatctggaattccacattgcttgaaattacacaaaacctggatttggaaagagaaatcttatttatgtattttttaattttttatttcttatagagatggggtctcgctgtgttgcccaggctagtctcaaactcctgggctcaggcgatcctcctgcctcagcctcccaaagtgctgggattacaggtgtgaactactgcacccagcctggaaagagaaagctgagagaataaaaggcctctatgaaagctgaaaaggtaatttcaactcagaaaaaagtggctactaaaccttgaggttggtttaagggcgaattatttttatcttgagttatgcataggaacattttaactggtaattactaaaagtaataaaatatattagaaagtccaaacaattctgtaatgctgaaaagagaaaattataaaggatgctgcattctgtagtctgcataggattttcacatatatcatctcccttaagcctatcaaacaaatgttgggaatgtgttttatgcccattttattttttttatgccaatgattgggactcaaagtagttaaatgagcagtctgcttgattccaattattgtgttctttatgctagaaaatatttctagcatataggctgagaaaatacatacttactataatactaaacattgaccatggtctgaagtgttgtattataaatgcaggtaggcatgcctgttagtccaacttccttcagactattaattgtacccaaatagactattaattgtgctcagctattgttcatatccatgaacagcataatattcaattcagttcctcagtcacttttagaatacacattttatcaatgaatttaaatgaaataattatagtaattgaagtgccttacatgcttatatgagacatgcgcttagagggtttttaaatatgtaactacattacgttgaattactactaatataatacaaagcgttaaaattaaaatctgaaaagcagaatgccgtggataacccctggcaagtatgcattagcttccatggcagcaaaccacatggtgtaagggaagctgtcctggaatcagactgcttgacactgaccttgtcacttacttggtgtgcaataccaggaaaatatcttttacttctctctagctcagtttactccatcatatcatacattccatcagagttggagtttttttgtgttttttttttaatttgatgttgtgtttttagtgtctagaatagtactcaacatataacaggcatttgatacatttttttgaaaagatctgcaaagtggaatgactatattatctgcccataggatgcttcaaaagtatactgtttaccagaattcttagcaaatataggagatagtagcaactaacaaatatgggaaatgctaatttttactattgaaattgtcattaggttttattattatggctgatggtaaaagaagtataaaaaaataatgaagctggtgttttagagaaaggccctccatctggggcagcacatttgtatctaagagttggttcactttagtcaaacccagaggggagagctatggctttatgtacattctcactaataaaagtttgaagttgccttgaacctctgtttcttctgttctccttcacttctctttgtctcacagaaaatcagttggttcttttacttctaatggtggagttcatcctgaatttgataaatctttatgaaacaagattctgggaaaacacacaagcaaacaaaaccaaaaaagcccctaaaaacttacccgaaataaaccacctgcttattgccgcttcaggaatgattcatttttctgtgtctcaaatacaaggtacaactctcaaaaaatgtctttgaagcaaacttgtactgctcttggctgttgataacctggctgtatctatccatctccatctgtctgtctagctacctatcatctatgatgatagatttcatttaatacagagaaaatttggtttttatttttccttcctttctcccttgtttcttttcttcctatttttcctttgtttcgtcttttctttctcccactttcccttcttccctcccttcatctagatttctctttcttctttttcctttttgtcatttttcttctaagctctataagatttataaagaagaatgaggaataagataaaaatcactcgattgtgatttaaaatgcaggtagacgtatcaagaaatgtgtcttttggagccctccttgacccctccccctccattttcaacctagagttaataaaaccctcctttgagtcccattctaccttttacttgcctctattggcgaacttaatatgctttatttatttgcattgcatattctcagcacagtctcaataaagttttgtttatttctcaacttgaccttgggcaaatttttctttgcctcttctcactccacctttctgttgctccctaattctcatttcaacaaagggttgttgctgctagtttctcactgatgctacactagaagtctatgaggtgtctgtttatctgtaaataaaacaatgtatgcaaattatatatatcagtaactcaaatgttattattttacacatttgtttgatgattttaaattttcgaatattaggaataatttttttacaatgttttaagagttttatcctgtcttgtttatatcataaagatgcaaatgaaagctttagtataaatacagtgcagcatttagtagccacacccgagagcttagtcactggtagggacagatatttgtataggtggattttaattgttggaagcatattttcaattctcagtgtttgttatattaaaatataagaatgcagagaaactgcatcttttatatctgctattacattgaaataaaacagccaagggcttaaattttatttttaatcccattttctaatttcaatatatatcttattagcttttatttttgtttatatttttgttaacatggatacagtagtggtatttgagctgttgcataacttgcacagacctctgttgcctccagcatggatcatatattcattacgttcaagagcatgcttactgctgttctttgtataagaggtcaatgtttccctattgcaagatgaaattcatttctgttacttcattaaactcctacatgtttgtatatagctacaatttttatatgcaagtgctgtttcaaggcaattaaagtgttattgcccctccctcccggcctccctccctgcctgcctccctcccttcctgcctgcctccctccctccctccctgcctgcctgcctgcctgcctgcctgccttccttccttccttccttccttccttccttccttccttccttccttccttcctctctctctgtctctttattattgtatttgaattttttaggactgagttagaagaccaattacctataacctgtgtgcaaaattaaatttagaatattaggtaggaaagggataactgtatctttcagggttagggctaataaatttatttattgtctgtttttttcccaatgccttatagaggcactcaagcatttaaatccaaagcaacatatttctaattggaattgttgtattgatatgggaaaagacccaatgattttcttttccccaaggtacctagtgttcatatactatctattctccaatcatgttaatacattcattcattctaaactgttaatgattgaacatgttgatgcaggatttttcgtggccactttgccagtcagggacttctgtggccagcaatgcccccacctaggccttgcttggccccaggcctgccacaggaggtgttacactcactcagcccactgggccttgcctggcttgcataccagctcagcccatggctgggcagagtgtgtcccagcccccctgcattacggcttgtacccatgtttgatggttctcgagttcttgtcccgcgtctgagaaaaatgaggttactccgacaactgaaggctgagtgtggcagagaagaattttactgagcaacagaacagctatcagcagaaaggggacatgagggtggccccccacctgaagttgggtggtctgtctctctcagtgtggctgggtctgggccttttatgagctcataatgggggagcacgtgctgattggtttgtgagtatgcaagaggctaaaacaaaggcatcattcaaaggttggcaggacagcatgaaaaaccaattagggaagggtaggtttatgtaaactaagtgaagggtaaggatcaatcagaggaaagtgtgccacatgggaagagagggttttaatccagtccatggatttaacttgtagcttggcttttaggttttaaagtgtctttggcttgaaggtctggtttcaccagggacctgcccctgtctgcctagggattagtctgcttcttgccactatcagtgtcactcttcacagcaatattttcaaatgaaggaatatttaatgaaataggaaagtttatgtcaaactcagaaagacaaaagttgggaaggatcttggaaccatacacatccacagtaatggttcaataaacaacttttctagaagaagcattttgcattcttgctactaattttgcattagcttccttgctaattgacttttctggttgatgttttagttcttaagatctcccttaaggaatcccctttccagtcccctttaaattccgtcacatgggactatcaattgtacctctgcaaacaactcctgctttctgcttcctttgaatctgtgcaaagaaacaaaacataaaagacaaaaaaattgtattgttggaaaacatttaaggtatttattaataaaaccagtgtaacatttttgggctatatcctatctaagtgtgccacaacatcagtatccttttataacatgaataattaaaattcactgatctgaatttaagcagcttaatctggtaatctgagcttctgatttagatgagtgggcaaaaagtcaggtgaatcagagggagaagtggagactgcactgcatggtttgccagtcataatcaatctactgttagaaattatgaggaatttcctttgacacataaagcatgcaaagtacataacttgtttccatctaattatatacttgtgtggtgaatgtgttgtcagattctaaaaccatctttgaatttgcttttttttcccaccttggtactctgtgctttctgagattttatatggtcacatgaactgtgagtgatgctcaatattgacaagtacagtacaaacagcagatggtaagatattgatggagacatttgttaatgggccagttgtcttgcttagatgtacagctttttggcagagttttggcctttttttctgcctttccacactgtctaccttagaaggaggaaaaaacccaaatctcttttatgtttttcatggggaaaaaaaggaggtgaatgtcaagatagcatgagccttaaataaaactacccttagtaaatggagctactatatcatgaaagaaaaatttctctaaaaataatataatttctttgaaaagattaaaaaaatttttttcatttttataaccctgttagtctcttcagtaattcatgttttctatattggatacagagctttgtacatttttatgtgtgtgagggtggtgctgttccataaccaatggtaaacactgcaaggaaaaaatatatcacatgagtcgtttgaataggtggtatgggggctgggcttcctaggatctctggaaccatacacatccacagtaatggctccataaaccacttttctagaagtagcattttacactcttgctagtcattttgcattagcttcttcgataattgacttttcttgttgatgttttagttcttaagatttgccttaagaaatccctaaagagcttctcaagcttcaaccctatttcaactccaggtttgctcaattacctgagagcagggagaataccaactttcccaagagacttttctctctttttttaaatttttaaatagacatatcataattatacatattgcttgggtacatgtgatattttgatacatgtacacagtgtataatgatcacgtcagaggtttttctttttactccaaagaaatacaaaggtttgaacacagatacgttattgactccactttctgttagaggaaggttaagaccttagaaaggaattgctgtctccaatcttattcctacagctaatttcactgactttgagtagagtgttctactgattgtcattcaaatgagccacacctacattgccctttctgtaaacctttgcagatttctggaatatgagctcatctttattttgcttcttctgtcctattccctgaagacctcagagaaacttccgcagactggaagtgtcttctcccctgagctcatgttgcatatgcaattttaaaaactcaagtaacaacacaaagaacacgtgagatatatttaacttatcaataaattttaacttatggagactttaaacaaacacgtcagaattttaacttcaaaacaattacatctatttatgggaatgtttattgtgtataaggcactctgctcagttattttaagtttattaaggatatataccttagttcatattattctccccataacccaggaaattaaatacagttaactgtgttttaaagatggggaaacagagactgggggtttctaatagagatggggaatttctatggtcatacatcaagtaagaatgaggcatcgaatctgtacatcagctaagtgggccagcttcctgattagaaatgtcagggggcagggagactaggagttcagttcagtagagataacacctcataccatttagcattctgtacttctaaatgctgtgttgttaacagaatatatatttaagaatggaagtgaagaactcaggacatctttatgaaaatcagagcatgcgtaatacgtaaatgaatattgggatcaaagtgtttgttaaatactatcaacatgaacattcaaagttcgttaatcttgagcatgcattaagaggtttgcagggtggcagagataacagtcaaaataataactttctataaaaaaaactggctattaagaaacttctaagaaacaaaagggactaaaaaaaactcccatccttgttttcttgtttacctttacatacatatacctttacatatatacacataatgtgtgtgtgtgtatatatatatatatataaatatatatatatatactaattattattattttgagatggagtctcgctctgttgcccaggctggagtgcagtggcggcatctcggctcactgcaacctccacctcccaggttaaagtgattctcctgtctcagtctcccgagtagctgggattacaggtgtgtgccaccatgcccagctaatttttgtatttttagtagagacagggttttgctatgttggctaggctggtcccaaactccctgcctccagtcatccgccagcctcggcctcctaaagtgctgggattacaggcgtgagccaccgtgcccggcctaccttaatatatgtgttttaattgcagggtttcttttcattttgttctggaaataaaagtttagaggataaaatcttaaggagagatcttaaacatactgctgttacagtaaacttaagcattcttttctcgtctgcagaaggtgcacactgtacaggacctcatataaactttaagcaaactttttttcccctcacatgaaatcaaaatcccactctggggaagcaactggaaccgcaagtttggtgctccttgtagcacctggcttgccctttgcccccttgattatattctcctgccactctcatgtcccctaaagctgctaacagcagagatactatgaccttcctggatcttatctgaagtggacaataatgtgaaaaacgaaaaatcaacctgaatttattttcacaattttgtgagttttgctctcagaaaagagcattcgtggtcaaaacatctggattttatcttcttatccatctgttctgtagtttgtcacatgtccatttagctgctagtaaaataaccaaaccaaataaaaataaaccatgatctcctttgattgtgaaatataataaaatttctagaatatttactaatttgtagcattcaagtgaatttgtaaatagaaagtcagtacttctttcctgtttttatataagaagaagccaaccctgccagcaggaagatctggagttgaagagattaggtcagatgtagtttgttttttttgttgtttgtttttgtttttgtttttttttttttttggagacagggtctcactttgtcacccaggctggagtgcaatagcttgaacctcgtgggcttaagtgatcttcccttctcagcgcccccaagtagctgggactacaggcccatgccaccatgaccagctaattttttaattttttgtagagatggggtttcaccatgtttgcctaggctggtctagaactcctaagctcaagaaatgtgcctacctctgcctcccaaagtgctgggattacaagcatgagccagtgcacccggccttcagatttaaatttgaacaggcacaacttcactgtgaacctgaacacttaagctattctaatgtactttaatttcctttgccacttttacttgcatttagctaagaaaataagcaactattactattgtgctcttggtcattttgtgtgtctcagaagtacaattctaaatgaatcataaaatcgggtgttttcatggtactgttcattgttagaacatcatatcaatatattataacttcataaataaaatttatcacccttggcacttcccagcatgattaaacatttgtgaatttaaagacacgttaaatttggcagtgcaaaagcagctaacaatattgctaaacatgtatgtttttgtttttgactcatatgtgatcttctctgatccagtattaatcttaactttcacataaagaacagtattcaagaaaatgcctttctttttttaaagggggaggaattggaataacaactaagaatgctttaaattttgaagaataagagagccacacttacttatttccaagagatacatcacaacatatttctgcctttgttagtactattttctatggttacttatttttttaaaatgcttgggaaaggactagcaatatgtattaatttaccagccatcatagtgagggcatttaatgatttataaaagacatatgaccatttgaaatgacctaattgttctcaaagaactgtcttaagtataataattaataattaaacagtcaacaactctttaaccatgttatagataatatatttcatttgccaccactttatactatatacattaagaatgtgtgtagagggtgctaatcttgttgcttagatgtaattatatttacttgattgttaaaagctaaattattatagtatatttttacaataaaaaggaatttgatacttttgcatatagagtctttaaatggatgtagggcagtattttatttcactatttatatttgcactgtgtgtttttgctaagtattagttattttatttatttatttatttatttatttatttatttatttatttatttttgagacagagttttgctcttattgcccaggctggagtgcaatggctcaatctcggctcaccacaacctccgcctctcgagttcaagtgattctcctgcctcagccttgcgagtagctgggactgcaggcatgcgccatcacgcctggctaatttttgtatttttagtagagacggggtttctccatgttggtcaggctggtctcgaactcccgacctctggtgatctcccaaagtgctgggattaaaggcatgagccacagtgcttggccagtgttagttcttaataggcacttctttggctctagaaggctatgataagtatattaaaatgtaattttgaaacaaaaactaatttttcccctcaatctcatgtgcaaatgtattccaaagtatattttgacctttgtaatgatgtttggttgtattttatgtaaaagtgtccataggagaatgcagctcaaagtaagagttgagaatctgcctgattaaaagggaagaatatgcagtactatagtatttttttccccttgctgaatgcagttattgcagtgggtattgtcatttcaacaggcagaattgctgcttacttaatggtagctggtggtctccagggcactttgcggattccaagaatgcatagtcattccaagaaccaaaaatattttgaaattacctgaaaaaaattctagttcagtcatttctaatgcgtttacaactctaaacctaaatattaatgctagaatgtagctcatattatataataaaaatagactgggcatggtggttcacgcctgtaatcctatcaatttgggaggccgaggcaggtggatcacttgaggtcaggagttggagaccagcctggccaacatggtgaaaccccgtctctactaaaaatacaaaaattagttgggcatggtggcaggttcctgtaatcccagttattcgggaggctgaggcaggagagttgtttgaacctgggagatggatgtcgcagtgagccgagattgcaccactatactccagcctgggcgacagagagagattctgtctcaaaaaaacaaaacaaaacaaaacaaaacaaaacaaccaaaaaaccccttaaatataatgtctgaaactgtactagtgtaagtggtatctggctgtagtgttccaaaaatacatttgcaaaaatgttttggaaaacagacaatatgttagcattaaaacaacaggttcccacaccagtttgtagagctaatttaacccatattgtaccacatagggttacaatggactatttcaactatattttatcaccagacttttgtgttcatttatcgtcatgagcatcagtggaagacatttgtaagcatcagggaaagaggatggaggtggagatgtgggagaaaaagtatgtatgagaaagtctttttctctaaataactaataattccttctgtagtaagttatgatccatttcaatttgacattctgaactttcttattccagcagtgggagtgaagattccggcctctttggatggccagtagcagggacagaaagggacagacgagcacagcataagctgagcaacatacaatcgtgctcctccagtagcttgcaatccagagggaaggctggagtttaggttcattgtcttgtgcagtggtgaagtttcataaaagatgttgggacaaggaaggggagggagtcattaatgcctacagaggagaaagcttttatattaggcctgtgtttcagtaggggctaaagtgtgcaagagcattgcaatacattaatgtgatttatgctccatttatgtgcattaattgattcttacatcatgccccaaagttttctcttgtgtcttgcatcaacattcagtaaaaaagaactccatctctgctgtttttggcagtgagatatattttttgttgatttctgtcctaacgtctactgatctcaaattacatgaaaagtgccatttttgtcatttatatacaagacaaacaagctttacatttcttttatccttagcatttaacaaaatgtttatttcacattataaaacaagttctttccagacaaaagttttttcttttttcctccctcttcttcacttcacttttcctccctcttcttcttcttcacttctcctttaccagtgattttttttttaatttcaaaatattttacaactctgctgaggctgctataagaaaaaccatagactgggtggcttaaatgaaagacatttatttttcacagttctggaggctggaagtccaagaataaggtgccgactcattcaagttttggtgagagctctctttgtggcttgcatgtaactacctgcatgctgtgtcttcacatgctggagaaagaacagtctttctctctctcttcttataaagctgctaaatgcattatgagggcctcatactcatgatctcatctaaccctaattgccttgcaaaggccccttctccaaatacggacacactggagtttagggtttcaacatacacattttttgggggagacaattcagtctacagcattcaaaccaaaaccaaaatacccctggtgacgtcttcaattgtcaccttaattctcttggttttagtcagatgaaatgtgataaatgagaggtttcagtatatactataaccgaaaaggaggtagtttttctgtatctctcacaatttcttattttcaacagcctcttgactttacatggtggaaatgtacctcatatagactcacatatttttgcagcagctgctttggcttgtttgttctaaataattatttgtttttttcaaatgtgtaaaattttgataatctacatgtgtcagtgtgaagaggtactttataaatgtttgctactgtcagtattggaaatcttaatttatatggaaagaactttgaacaaaatagtcacctagcatgtgtatattagtaaataaacattggtatcaaatatacttaactcataataggagaatgtaggcaaagtgataaaagttcctgtggaggtgggtgcctggcacagctcaggtgataaaccaaaagcattaaaaatactgggcttgttcctactctgagaggatcaggtaattcagcatttcacggaactgtgtacctttttgagcatatttgccactatttcattttgtatgtatgaagaccaagggtactgtccatttttattggaattcctgagtctgttctatcacctattttaaataacatcattcttctgtgattcccttttcccatgtaactattacaaatcttcttcctactttctatgtctacatttttgctgctctatttctctttagtgctttctctcccctagaagggctgaatatgaataattgaatggcaagcagtttttagttcagagtggcagtggtaccgctggcagtcttgcctacaagcatccttgggatggaaaagttgagcctcagggccagtttttttctcttttggaacagattagtggcccaaaaatctcaataaaagaaactgaagaacaatttctgtaaacttgtctagtgcagacagatacctaacatgacttatgatctgtttttcttgttcaaggctgtgttctaaacggcaaatgtgtaaatatacctagtgggtttattttaaaatttctgctgacttttaggttactagataaaatataagtgtgagtccttcttttacaactgtggagctgaagatttagaagaaatcacaataccatttcaacagaagtattgaatggctgaatgtcaaaccttagtgagaaacttagtaagtgttctgtaaatcccttgttaccatgatatatttcatgcagaaatgtctccaaatacatttacgttcttgtttgtggaacaaacagtaaatgtttttgaacaccagttatataatagattttatgccctgtctagatatctgaacatgtcacttaattagttttaaataccaataattcatctaatcttttcagaagcaccattttaggccatgtaacatttaccgtttcacaaagcgcattatggaggaggtggtccccttacacttacttagacaactaataacaaataaaaggtcattctctgatttaaggggtcactttccttttttctctggaggactgccatcccgcccactgcccactcccctcccctagcagttctctgaatagtctctgtgaatgggccagcacgcctctgtttaggcctcagctactcttggtgcaatacttgaaaagagcaggtgcaggtcagaagtgaatgggacagcccaagatcactgctgggaaacatgctcaagcaagtcacaaactaatctgggaatgacttcagacaaagaaaacaaaagaatgctttacagtcaaaataacccacttgacagagaactccaggatgagaagccttgggaaggactagttgcttctgtctcactttcattttagttctagtaaattttagaggtaaaggacaaaaccctggccatcagaaaatcaggaaatttccttaaattgaaaagaattcctatacgcagttatttatcataatcctttctcactggaactctgtacagtctgtaaccctgcttcaatttgaactttatttctcttactttgggattcacaatatctttgttgaggatgcttccttcaagtcacgaagattcacgtcctccctgatatgtttttttcttaatagtctcatatgtcagtgggtaaaataggtctattaggaaatatgcagtatctataaatatttttgtatttatttatacacttctatgaatataaaactataggaaataaaatctgtacaaaagtaaagactggaaaaaggcaaatgcaaataagaggccggggttgtttgaatgcaaatatgtagaccatggatgttacatagctattaaaaattgacctgagaattttattcttgagttttctaccagccaaagtaagaagggaataaatctgatgtacaatttatatatggaaatagtgtactaattgcataagggagctcaagtattttttcctggtgcttaagatgagaaagacagccctgccataaattttcaatacttgagttattgaagattcataactgcaggattgaattttgtaaacttcctcccataagaggtaagggtaaaataataaagccaaacttagtaaaagtaattttgcagggttttgagacattgtggtccaagaacatggctttgttctgtatataattagacaacagaggaatgtcttttaaactgtctttcataaatatcgttgctcttcaccaagctaatgataaaggtagtcacaaataatttgagaatatattctctataggatcatggaatctagatagctttgttgctgtcaaggacgtattttttttttttttttttttttgagacagagtctcgctctttcgcccaggctagagtgcaatggcgcgatctcagctcactgcaagctccgcctgccgggttcacgccattctcctgcctcagcctcccgggtagctgggactacaggggcccgccaccacggccagttaattgtttttgcatttttagtagagatggggtttcaccgtgttaagcaggatggtctcgatctcctgacctcgtgatccgcccacctcggcctcccagagtgctgggattacaggcgtgagccaccacacccggccgtcaaggacatatttatacacattaataataaatgtggccgggcgcagtggctcatgcctgtagtcccagcactttgggaggccaaggcaggcagatcacttgagaccaaaagttcaagatcagcctggccaacatggtgtaacctcgtcttgactaaaaataaaaaaattagccgggtgtggtggcatgcgcctgtggtcccagctactcggtaggctgaggcatgaaaatcgcttgaacctggcaggcggaggtcgcagtgagccgagatcatgccaccgcacaccagtgtgggtgacagagcaagactctgtctcaaaacaaacacacacatacacatacacagtaaatgagtagttgggaggttataaagttttgtgaaaatttataattttgtgaaattttaattatataaattttaattatatatttcacaaaatatataattttgtgaaattagtcaaaatgcttattgaatggaggcccttccctctcacttgccgcctgtctctataaaaatatgttctagcagaatgtctagagttagagcagactttttattatataatagtttggaatcactcacatcaaaaattgaatgatcaattctccaaacatataaaacttaatcataggatatttttacctatcaatcataggattttttcctctatgtctagactctggtataaaggaagtattgacataaagttgatattatgaattacatgaaagcacaggcttgagttgttgtacatgttttggatgttttctacctttccagttgatcacaaaactaattttcctactttaattttatcatcttctttggaggtgagaaaatttgagatttgaaatgaaccatgctttaatgccaaaactttctgcttcatggatactgtgataggagacaattatagtttgaaaatagaatgtaaatgtaataaacttgacaatttaaaagtaatgctatagtggagagaaggtgggttatgggatgatgaagggatgtggcaaggcactaatttattttacttttcatacttagggagtaaaaaatattgcctaaagcctatggatagtccaatattaagatgttacttatttttaatggaaaatagtgtaaaaattaaaaataaattataacaaagattggaggaagggtaagagaaagaaagatggatatatataggaagagaggacaatagtacacatgagataattcccatagatttcatagaaggaatgagttggcactctttacagtgaaagagtcaagaaacagaggtgaaaacaaattatttccagttcttaccatagttaaaacaaaacatatcaacagaactttgtgtttttaaaaagttagtgagtggttcaagatatgtattaattttgaaattttagacaattgtctgagtagtcagtaatctttgaatgcatcccaggacaacaagtatagacacacagaccacgttttcctaaatgtccttttcagagaagttcagataagtttaagttagataaaaataatcattttttctaaaacaaatagttcataaattgttacaagtgataatgaagaaatatgtttgtatttgttaaaatatttctcaaattttaaatggtaaaaaatatttagatgcttctatgatttatcaagattgtctttgaaacatttttctagggagaagggcttaaaaactttaggtgaaaaaaattatgaattatgtttccatggattcttgtgatctatgctttgaaattcgtcagtcagtagatatggagttgcatcagacaatctgtaatttttaaagcttacaaatgaactataatgctaatggttggggaaacatttgagaaactgaattaaagaactactataggccacacacatgaaaaggcaccacttcttctcccagtcccctctctcacccctgtttaaaaaacacaatttaacagagacagatataattttacattaaatttaaaatctataatacagagttgaggagaactggcttagatgcagctcccgagtataacacacacacacacacacacacacacacacacacacacacacacacacacgagtcaacccctgcacacatacagtagcaacagcagcagcagaaagaacaatataacttaaaacctaggaagtgaaattgaatatgaatatgaaattgccatcctgacaaatacagaacttcattctggccagaggacatcttcaatggtggcttcaggtctcagagtcaaattctatttaacaaatttattggcaagttaggttatttttaaggagataactaggatgctaatgtattaagaaatcacagtctaggaagagtaactaataatttggtgtttttaacaagtctggagaattcatgacaaaattaggcatataatgaaagcatcagaaatgtagagatagctgtaatgcacaaaaattatagggagacagtatggttcaaaagaaattctatcgttaaaaaacaataacaaaatataatttttaagaaactgagctcataatcactcataatgttgaatatagttacaataactgctattgagcacttctatagtaaatattttttaaatttatttatttatttattttcagagatagggtcttgctctgccacccaggctgaagtgcagtggcactaacacggttcactgcaatctggacttcctgggctccaatgatcctcctgcctcagccttcttagtagctgggactacaggcacatgccaccacgcccagctaattaaaaacatttttttgtagagacaggtctcacaatgttgcccaggatggtcttgaattcctgggctcaagcagtcctcttgccttgtcctcccaaagtgctggaattacaagcatgcgccaccacacccagccttaatattcttaaacccatttaatccattattttatttacttctcacagcattcctaagagaaaggtaatgctaagtagctatattttacaggaaagaaaatacaaatttaaggagacaaagcatcctgcccaggatcatacaggccatacatgataggaatcccagttctgactctggagacctgaactcccaagtgagaagataaagccaaaatgtagtatatttagactacatcctttggatgaaggtttgacttagatgacctttaggaatttgttttgtttttaacatcaaccgtagaaagaaaaagctaggttcacaaggggacttgggctttcctctctatgcaaattctttggaccaggaagagaaagagattgggaacgtttcagtcgaggccttatgatcatgtggcaaggggcagaaagtgcaagaaaaagatctgtcctttaaagggttcctaacctctaatcacagtgactcttgattattagtattcatgggccaatcaatatttcaagtgtcaaggagtaagatgatcaaatccttccattatgcaggggaaggtgagggagtataccttgacccagaaagaaggaggcaaatatttcaatttagggagaaaaagccaaaataattcctctcataatttttattagatttttctgcctgcattcttgttagaattactaaaagttatagtggctatactagctctgaaaataaaataggggacaagacatgccagcatggagagttgaatcctacagatggttacaattgcattgatccaatataacaattctgatctaaatagaaaagaaaatctaataccttccaaagcaactctgaagctttaatcaataactggaatgttaggttttttggcaaaagaagagatgttagattttaaaagctgactgtatgaccccaataaaaatgaatcaatttttattaggaatggaacctggcagttttacacaattcatccagattttcctgacaaaatttgaataatggattagctctagtggaaattaggtaattttttgtgcctttaacatgatgcacaagaagcttctatcaataatccttgcattagagaacagttttgaagtaggcaaacagcatgtattatacagtgtcatgtgtatataattatctcagcatgctgaagggtggaaaacaatcttcaagtggcagagaattaataaccctccatttcattgttcagcattttattctaaagtagtgttggttttgtttctgttttcctccatcgcctaaaagattttcttaaaagtataaagctgacattgctcagtacagctcactttcatcaacggtgagctgaaatgctgttcacagccaaatattttatttgctagtctctgagaaggctagtagcaagggaaaatttaatcaagcttggtactatatggaaattctatacatacacagatccaggcttctaacccacatgaatttttaaaagttatatacagagatgtatattcggaaaagaagtgtgcaactgttcctttcagatgagaagagtttaatcattgctgaccctactgaattaataagatgcctgctgttttggaatatctattgtttacttactgtgagaaaaatacacagttcatattcaaaggttatattttatctcatggttgtttccctttaaagagaatattagcctcctatttgggaagtaaagcaaggacaatatctaaaatcatgagtgttaggttgtcattgtcaggttcccagctgttttgtaattttgataacaatagagtgaaatgtatgattggtgctgtgtgcattaaatcttgtttcatttctagtgtgtgagtgataggtatttgttcatctgcttagtcatatggcaagacggataaatatccattaaaagctcctagtaatttaaaaatttgtttttaaaggatttagccatgtttgggatctaactacatttcttacccatctcccaggctgatgaattggacaccaggcagatttttttttgtgtatgtttttgagaaaagaagcacagacttctcatatttaacaagaggtagggggcttaaggccctgaagatgccctttggaacacctattttctatcccccagctttagatgacacagaaacacagtgacacgtggtcttgttttactgatggacagccaatgtgttttcagtcattaagcttcctcctggagtcaggagagcccgaggcaatcaccagtaactgattttcaccctagagacctcaaagacatgctgtttggggctgtgggcaattaagacagtctacaatgaaatcaataatatttggggggcattgaatatatttactaagcactgtgctaaatacaaagaaatacaggtcgtgccttgccctcaaaaatctacttctttatggaggagaaaatacacacagaaagctcgttaactttgtaataaaaaaatacagaattgtaagaagtgttgaaagcagtgcctgattaagtggaccaatgagtggtgtagataatacgtactccaagaaaataggagaaaagaggcgccatggggctggggtaaccaactgggaacattttgtatgagaagaggttagaactggacacacactccccatttctacacccccatactcttgtgatcagggtggctggaaatttgatcttggcacctgcagttctaacaggagggatttggtgatgtggctgggaaatctatggcactggaaaaagcccaggaataagccatgacaatgtcatctctagaacctgaaatgcaagcagccaccagtgactgcattctccactggcctgagggtgatggggtaagacagatagaaaagtgaaagacctcagtgtttcagtgtgtgtgcatgcgtgtgtatgttggtgggggcatgtgagggtgggacattctgtttgaaagttgtgtttctgtattgtttctgctcattttttcttctatctctctgactccaggagggagtgccaatttttcatttgaaattcagatccaatatgatatttttgggagtaaatctcttatattccttcgcattagtgcccttagcttgttggggattagaaaactggaatctgttttctgaattctaaatccagctacgtacttaatcctttagagagatcccttattttctactttcaaaatgattttattgagataggttttaataagggaaaactgagccacgtagtcagcagatacaatctacatatccaagaggggtgttgccaggggaaagaattcttttgtagtcttttttctttttttggggggcatttttgtttgtttagtgtgttctttttttaaattttcaaagcaggtatgtgctttgtttttaccaacaaaatttaagcaactacattgtgcaaagcactgctgtataaaaagcttttattattaaggtgttgctaaatctgaatgctggtacctttcattcggctttatttatttttccatttatttaattgatcttctagtactgattgtggccaccataaattctcatttgcaaagatggatgaaacagtgacaaaagcatggatcaaagcttaggaggagcgcatgtgtttgtctgtggggtgtgtgcgtgtggatgtgtgagatgtcttgatccatttgtacatttctctggggaattctcaggcaattaagtcaacctattacaaatagagccgtgtctgtacgctctgatttgataggagaatgggtgattcctgttaatgactagtacatctggtcaattatattgttttgtattgatgcttaattaggtgtcaagttggaggagggggagatggtgaaagcatgactcccttttaaatgtcagagactcttcctaaattacctgtctttttaacatacatgaaacactttgacaggcattgtgttcttctgaccttaaaacatttacactgtcttggagaggaagtgtaatgttccctggcaagtaagctatattggaactggtttgccttgaatgttgttcatgtctggtttcgtgcggactgacccatgtcaacctttagctggcaacagaaggaagccttcccatgggtgacacaacttttgttaaatagccttccattttcaggatggttttctttagaaaatactgccctgattgtattgtttgaaactatgatttacttttttcgtacacttgtctagatagaagcaagtgaaacaccaattgcatatttttgttttaaaatgtatgatcacactgaacttatttggagatacactaatgcatagatttattctgtaaataactatttatacattcaacccttgaaaacacaataggaaaatatttgtaacagaatggagagtgtctaaggagctcagtgttctgtacattagctagggagttactggtgccacagtctaaaagcccttttagccagattgtaggcataatttttattttttattgaagtcaatgggtgggtggaggtcaaagattattacattttacttgacaacttatgctatgtcacaaggcagtacgatgtgttttaatacaattgtgcattatgtatgagatcctgtaacaattaaaaagggggaattgacagcacagaaaattaagttcttaaaaatgaattataaaggttgaggcttgcttgaggaacagacgggagctagtttaatcaacaagtctataagtgtgtggagtgtttttgtggaccgtgtggtttttcttaaaggatgagaaacatattactatgttattagaaaaacaataaagaatttttgattttagtaacctcaattagaagattctttccaacactaaatgagttaaatggataaaggcagtctaggtagaacctgataattctaaaatgtgttcaatactcaattttttttttgagacagtgtctcactctgtcaccctggctggagtgcagtagcatgatcttggttcactgcaacctttgcctcctgggttcaagcgattcttgtgcctcagcctcctgagtagctgggactacaggcgtgtgccaccatgcccaggtaattttgtatttttagtagagatggggtttcaccatgttggccaggctggtctcgaactcctgacgtccagtgatccgcctgccttggcttcccaaagtgctgggattataggcatgagccaccacacctggcctgatattgtgtttattcatattattaatcattttaaccttaagatagtaaaatataagaatatttagaggaaactgtaaaccattctcttgattctacacatagtaatacttaatcatccattgctgtagattctttgcaagtccttcaaaaaacagggtgatatcatgtattttgaaaattgaagattttataagcaattatcaagatttttctctgcaaaccctattctaaatttgaataaaattattctcttttatgtcttaggtaagattagaaaataaaaatctgcttcataacaatatactgcaaaattttatacaatattagattttgcctcattgaatttatttctgctttctttgtactactcagttttgtaagtgacttattagagaacgaattccttcatatcttaaatgcactgaggaatctcatacttatttccagaggattgaacaggtttttggaggaatatttatgttaaaattacctggtagttttggaaacgctacagtaaagccacacaatattttgaagtttatagcttatttttgagctaatatttttgtttgctatatttttaattttggggatgttgccttggaacagaatttatatgtaagttaattaagcttgtagttgagcatgctttttgtatcatacaaaaatacataccaaagataatatccaaatccaataatctacagtttttaagcttcaaattatattagtttgttcagtatatgaaattgaagtttagttaatttcattttctttttctaataacagaatgtttattaaatatagaaaaaatactgaagggaattaaaagcatgaaaatgacaaacagttgtacaacatactaggcctatagtcttttaaagaaattgcatgttaaacatttcatagaatttcattaaagtgaaaagtttttttaaagtctcatctagaataaatgattttttggtagagttttatatcaagagcacagctgttctaatggaaataattattggttcttaaaagaattaaagctggctgggcatggtggctcacgtctgtaatcccagcactttgcaggcagatcacctgaggtcaggagttcgagaccaacctcgtcaacatggtgaaacccccatctctactaaaaacacaaaaaatagccggggatggtggtgtgcgcctatagtcccagctactcgggagtctaaggcaggggaatcgcttgagtccgggaggttacagtgagccgagattgtgcgattgcactctggcctgggcaacaagagagaagctctgttgcaaaataataataataataaaataaaataaaattagggctgtagattagcaatacttttatttgtcagccttaagctcgaactcttagcattttagactttgtagtgcaaccccagaaacttagtaaatatttattacgtaccatacattgccttaaacattttctatataagattttttttaatccttacaaaaaccttgtgaattacgtgccattactggcctaatttttaaaatgatgatgtaactgtctcacatcgtctcataaacagccacaccagaattaaaacccaagtctagcccagagcgcatgaactttacccatcactttgctataaccttactaaatgagaaatactctaaatcatgttaattagtacactctttctgtgactaggtgtgaattagcctttaatatttctattttcattacattactatgcattattttgcaaaagatgcaagcagctaataagttatatacaaaataaactagagaggacaccccttataacccatctcctgcttacactacccgttttattattaacagttcacatgtgtcttttcagtagtgttcactgcttacagtgctccttgtgtgactgcatatagaatcagatatttatttttttacatatacatttggataagtctgttattatgacttgctttttcactaaagttcttgggatcttttcattaattattttaaaatcctttatttttaattcaatatttgaactactgcgtatttcatgcaattaatgtaccataaactgtttaaggagttcccatagatggtaatatttgggtttcttccatttgttttctattacaaatactgtttcagtgaacactcttgagcattttcttgtgatagaaacctagagataaattgagaataggtatttttcactttgaaaatatttgaacaatatttcctgatttgctttcaaagagtatgtgtatctacttatatctatttctgtatctatatctgtatatctctatttctatccatccatccatccatccatccatccatccctccatttacctatctcttccagttttgtcaatatttaaaaaattttgtttatctgatttgtaataaaatatttttgtgtattttaattatttaattggttattaatgaggctgagtttcttatcactaattttaatcattttttcctgataatttctagttctctgtatactgctccacttatttctttacagttcttatattgattttccaaaatttcatacttaaccttggtttaatttagtaattcatcagttttatttagattgttatgtagacagtcatattgctacataataaaagtttttgttcttttctttcccaaagcttttaccttgtatttattttcttgtcctagtacattaactatgagttctgtaatagcattattggactaattgagagtgaacattcttccttttgtctttaagtggaatattttaaagattttaacattaagtatttttttcacatatctctatggtagataatgtgaaagttaaagaactttctaacaccctaatattttagcaagaataaaaatggaatattaataaaaagattttgggggacatttattgaaatgattaggccgcttttgccatcatctgttaatttacaggattacattacaagttgaaaataataaaatattaatcatagttgtttatttagtatcttccaggcattgctctgaatggttttctttttgttttaattgatttcagtttctcaaacctataaaagcagactcagagaagttatttaaattgttgatgttcactcttaatttatggaggaactgggctattctaaggtgaaatatctatatcttcctaaaacaactattccttggtcatgatatactatttttgaaaatgtctgtctgatttgacttatcaatattttatataggattttgcttatggtcataggtgaaatcagcttattttctgtcttttttcttggcctgttttagtagtagaataacttcttacaatttcttgtgatgtaatgaatatacacattaattttacattcagaaaagtaatgttgatgctactgcaaactatcatccattaatatttactctgaaaaaagaactgttgaagtactggaggcagaggaagccagatcagattgaccagttagctggaaactgcagtagtccatatactagatgaaaaagtccctacaagcagtggcagtgtaaaatgtaaagagaagggggtggcaaagacagttattcaggtaatagaattaacattaattcattaaacacttaatgaattcctactatgtattaagcattagtcactgtcactgtctgcaggaagcttaaagtttaatggagagtttgataaataaataattactatgaaatgcaaaactctttttgataattgtatgtaaattttatagcatcctaaagggatttacagagaagaaactattaaatttaaccttaaaagatgactggaaattttctagaaaggagctttcaaggaagagacattcccagcagaaaaaaataggaagtgaagtgtctgtaaattggaaaaatggaaagtatatgattagtaacattctctacttaaaaatatttcaaacttcttcattttatacagaatgatctaagatgaacttaggttattctggaatgagaatgatacaagagtcattgttatgtatagcaaaagaaaaaatattgatagaagaaagcattggaagtgtaggaggattagtttatggagactccttatggaatagttgaaatgtaaataactatgactgtgatgtatctggaaatttctgaaaaaggaggaatatgttaggctgtaggtattacaaataacaagttcctatggctgtaatttattttaatttacttttattttttgttcaataatagaattctagtctcttagcaactctgggaaattgaggttagattaaaacatacataaaagatgtgaaataatacatttcttggaactaatagtctcaaaaatttaaagtaaagtaaaatagtacatggatttgtttaaagtctaaaaatgcagatactctattttcctttccatttaggaatctacttatgactttgaatgagagatcagctatggtgtcattattttcctgcttcacagaacttaatgagcttttaaaagtaattttagcaattggcaaagccatataatgttaaatagtaccctctgcatatttccacacaatttgtttggctgcttttctctgaagaatctaaacatttattctagtgccaatacttgaatttcatagggaaatacttctacaatcctttgggttgaagtttctgcttgctacgaggagcattcccataaccaaagcagatgctggcagttgaagatgtaggtagctgagcaaactggcagtggtggcagtgcctcttttaagtatgttgctggatcaaagctggtgtcgggggacagagcccagagatcattactcttgattacattgaggttgctaatgcgatggcttcacccttcttgaattttgaaattttatgaggaaacagtgatccttttattttttttttctgactccatatgaaacagttttgtggacattttatatacaaattcagatattgcaaatagaaaaattttttgcacataactttaaaagaaactttatggtctctgtgtcagctaagattatttttacccatatcctctccattctactagttaagaaaaaaagagaaattattggattaaaaagtccatgcttttccagtagaaaccttgttcatcacgccttgctaatataccaatttgactactctgcttgcttgcctcaaagagtcatcttttttttattcatttaatatttatctaggcaactattttatctcagtgcaaagataagtgcttttgacttctggtgaaaaacactttctcttgggctgtttacattctggagaaaagaggctgaaaacaagtaaatagacaaatataataattgcatggttgtgagtgtctgaagaaacaataggaacctgatgtgaaggacagaaagcagggaaaagtgatgaatttatgtagtatggttgagaattcctctgtgaggtggtgacatttgacctggtgcttaaaggaatgagacaagatacaaaggcatggagagaaagcatggtaggtagaaaaaagagcagacactgttaggaatagcttttctagccaccaagcatacaaaaaaccctccacatcactaatcatcagagaaatgcaaatcaaaaccacaatgagataccatctcacggcagtcagaatggatatttaaaaagtcaaaaatcagccaggcatggtggctcatgctgtaatcctacccctttgggaggctgaggtggaaagattgcttgagcccaggagtttgagaccagcctgggcaacatggtgaggccctgtcactacaaaaaattaaaaaacaaatagcctggcatggtggtacatatctgtagtcccagctacttgggaggctgaggcaggagaattgtttgagcccagaaggtcgaggctgcagtaagcccttttcatgccactgcactccagcctcggtgacagagcaaggcaccgtcaaaaaaaaaaaaaaaaaaaaaaaggtcaaaaccagtggatgctggcagggctgtggaggaaaggggccacttatacattattggtgggaatggtaattagttccataattgcccctgtggaaagcagtttggagatttctcaaagaacttaaaacagaactaccattcaacccagccatcccattactggatatatatacccaaaggaaaataaatcattctgccaaagagacaaatacactcgtatgttcattgcagtgctattcacaatagcaaagacatggaatcaacctaggtgcccatcaacagtggattggatagagaaatgtgatacctgccatgaaatacttcacagccatataaaagaacacataattgtcttttgcagcaacatggatgcaactggaggtcagtatcctaagagaattaatgcaggaacagaagtccaaataccacatcctttcactgatataagtgggaggtgaacattgggtgcacatggttataaagattgaaataatagacaaagattactagagttgggatagagagggggtcaaggagtgaaaaaccgcctattggctattatgttcactacctgggtgatgggatcatttgtaccctagactgaattcagcattacacaatatacgcatataacaaacctgcatatatactccccaaatctagaacaaaagttgacattatattagaataaaaggaactgcttttcaatgacggtgtcaaatactacggatgacacaagttcaagaccaaaatttcattctgttccccaaagtgaaagtgagtatatgggcctatatatctgtgctgtagcaacgagtggtctaggaggagagttggctttggtattatttgccatttggttccttttcccttttgaggctctcagtgctaacgtttctccattcactggctaagagagtagggagtaaagaggccccctgtcagaatgatagagaacaacaaagacctcctcccagtagtagcttgagtacccaatattcttgtctgtcatctaactgtgttcaggagaaaataactaggagggtcatgcaaattgtgcaatataagttcaggctgtcttcaaatctctccaattagccacctataacacttcaggacaatgtgaaagatgactacctaatatttagaagtaacgtatagctcttcagtatttagataaatgaaataattaatgtgtctttcatggaaaggctcaaaagcgtagctaaaaatgtagagatgcacaattatgaacttcatttctctatgtagccaacccaatgactgctataaacaaaacaccatctattcattgatctgtcattggtctacaccacaaaaatcaatgttatttgaatcccttactcacaatgaaaggatgtattcttgagtaatgaaaatcaatgaacattattttcctgagaataaattgaatgtaaacaaaaatactttcttctgaataaaaatagtcttataagagaattgtcttcacagttccatgtaaaataaaccaaagtaatcatatgtttcatcatatatgtgttaaaggttatgtcattttagtctagagaactgaaaattgtataccttaaaagttgcaatgaatatttgaacagtagtgcattagatagtgcattgtttacagtttttggtggaaggccaattttttttaatgtgcaaaagtaaattttcatttttaagggaaaccccacatcctttttctaaaatgtgcgttcctttctagtctcctttttctactgtcttccccacttctcccaacttccagatgtccttgtccctcatgccttctctcaatctgttttcctttgggttatctgaatctctttcaattccttgttttattttcccttttttagtcttatctagtgccaggtggctgtgttataaattgagggagaattggtcaatcaggaatgtgttatttcccctgggtttcctagctttatgccctccctgaatgtctctactgaagaggaaagacattgcgatgaacacaacagagtctcttgcattaatcctattgtctgcccattcattccataaactttcccttctgtcccatcagaaaactgaacacagggaacaagaccagctgggatggcaattagaaaccttttcgcacagtcctgacagagaagttttctttggatggaaagtatatacactatgcttgaatttatccaaggtgatttccatgtgcttttgaaaaatctagcaggaagaatctgattgggagggtcaagaataagattctaattcgagccctggcattaacataaaagaagcatattatgcacttcttagatagcagttttattacagaaataagaaaaaccagattaatttctcattttagtggcatttagcatggtgcagtttggtatcccagggcaagaaactacatacagagtggaggtctttaaacaaaactttttgaccatttctcttaaccagtcagggcttttacctttatatccacaggtggacaacaatgcagggactctataaataggtccttaatcatgctatgaacttcttgagctagatccatagttctcaattgatttgctctatctttgacatttgctatgttcttgtctccagctgcagtgccctagccagaaccctgcaatctttctgccaaactttttttttctttttgacacaggtctctatcacccaggctggagtgcaatgacatgatctctgctcactgcagcctctgcctcctgggttcaagtgattcttgtgtctcagcctcctgagtagctggcataagccaccatgcccagctatttttttttcttcgtagagacagggttttgccatgttggccaggctggtcttgaactcctggcctcaagcaatctgtccacctcggcctcccaaagtgctgggattacaggtgtgagcccccgggccctgccttcacccaacctttttgaatcatattcctttgggctacttgtttggttcttggcttcagctttgtccttggacactggctattgattctccttagatctatagtctgaagaacccggctggagaatcagacccagtccatccattaactccaagcctaggtcctagaatttagtatgtctagtgctgcctgaacaccacctggtcagaaagtatttatccaaaacatatgtaagatgtttattatcattactacttatttcgcccttagttgctgatttgcttttcttttaataaggtcaagataaaaagtctcaccttgccctttgcatgcatgtacttttattcactcctttcattctagttaaatctaaggataaagacaaacaggcggggcgtggtggctcacgcctataatcccagcactttgggaggccgaggctggtggatcaagaggtcaggagatcaagaccatcctggctaacacggtgaaaccccatttctactaaaaactacaaaaaattagccggaagtggtggcaggtgcctgtagtcccagctactggggaggctgaggcaggagaatagcatgaacctgggaggtggagcttgcagtgagcagagatggcgccactgcactccagctgggtgacagagtgagactccgtctcaaaaaaaaaaaaaaaaaaaaaaaaaaaaagagacaaataaataaaactatggtagtcagatgaccatatataactaagtcagctgcataaattataagagactattttatgtgttcttttggtaggcattagaaattggatgcctgaggacacttaatttcttttctgaaatttttataacttaggcatttcaaagtgataataatcattgaaaaattaagcaatgtagaagtgtatgtaaagaataggtcttatttcagggggttgcctgacaattcatacgacaattataccatcatttcttttgcacctagcagaactttctgacagtttgtgcctaaataaaaaggtttttagtagggtaatgaatgcccattgcaggaagtatttgagagaattaccatgataatttttcatgtgtaatgtataaaggaggcttccatttattaagaactggactaaaagaccatgatgttttcttctgcagtttctggaagtatttgaaaatattatttattacttgcagtaattggagaaataatctcagttcaaggttcgcttacaagatgtccaacggtgatacaaatgagtatgaggccactatttccctgatatgatcaagagacatgagaggataaaccagagctttgggaaaatacatgtagggtagttgaaaagacagttctgcagacagcaggagatgcactgaagggccttttttcctccattactgcaggtgacctaaaacaggtagtgtgaattctaatggattgcatgtgctcaagtccttttgtatttcctgaatggtgataaaggagtccattcagcctctcttctacagaaggaacattttgagagagaatataagggttgtcaggcctgtgggaggctgctgaatcacatatgattcacagatctagcctcagaaatctttagactttaacgttacaatacagggtggtccattttaaaactgcttgttgaaatctacgttgggatgtgctctaaatggagcactaggaacagtaacagaatgactaataatgacaaaaaaattgggagactgcaacaattcatttggaatgttgatgtttaattcatgttactggctgcttcatgattcttttatatttcataaagatggtgagttacatgggcgtgccatcttaagcagggacctcaagctaaaataccattctcttttcaccggagcttgttaaatgcttcctacctgtatctgagatgattgaatatgattcagttttcaagtctttgcttctaattatggaataattatttgaaatatgaaagatataaacatcaacacaaatgaggcttttcatgagatcaactattgtgttttaaagtgtttatttcacattttatgttaataatttaaattccagtaaccatcttgacatttgctaccccataagagagaatatagctaaaactgtgatttttctcttttgttagtattagcaaattatatgatactaaatatttaactagaaaaatgtttaaaaaagccttctccaataactgtacgtacattagtcatgtcttaaagcatgtttttaatctactgagcgtatgatatgcaagcttctattggatttagttatacaaagtgctttttctgcctaatattttaatattttaaaaaatttaattgcctagattttgacctgcttttcaacatataatacattaaagatcgcaattatataatttttttaaacattagcaaatgtttcataatttgaaacatttaacaattcaaattaaaaaatagttgaaaacatgaccaagaaattaaaaatgacttctttttctgtattacttggacatttatataaactttgcactaatggttcacagtttctgaaaggggttattggatagtgctcaaaattgtaacttttttgccatttgataaacattatttttaaacacaattctcattgttatttttactgcattaatggtgaaaaacagtttggtaaaaaacgtagtttaggttttcatttatattgagcaggttaggaaagggagctggctgtaattcctatctaagaaacaatcttctgtttagaatgttcactgtgctcagaccagcagaggggaacataagggcaatgtatatgctgctcaggcaaagagggtcaaagagaaccgtgttctgtgaggacaaaaaggttgaaagcaattaaattgcaatatattttctgagctagaaagatgtttaccatctcatatttgaaggcttcattcctgtttctctagaatcatttacttaatgttaaaaaaataaaaaagttgaagatggactaacttggcaatattcttttctgatggttttcagaaagagagttattgtctttctaatttgcaagttaatatatttgctttgacagctttttgattgttaaataaaccctgtcttagaagagctgtcagcaaattacactatgggctatatttaaaagaagtgccacatgagtcaatttgggtcctggttttatattcatacatttgtttgtatatctgaacctgcatcataaaaacaatgaaggccagctgaaatagtcatattttctatgcatattgaaggacttaatgttgcttttagaatattttatgttcataaacatatcagggctgtctctccacctaacctgctattgtatgtcaagtctgtttgcatgttataaataatatcagaatcaattgctgtggacctaatgcataacactgaggatgtcttgttatgttaatgaaagtagtacaacttctggttgtaagtaaaataaatggtacttgtttaatttgaaaatactgatgaaaacttaaaaatgtaacgtgaggaaaaattatagcatttaggtaattattaatatgcatgtatttccactgagatgtcttaaggaagaacctacttaggtattcttgtttttaaatcttcattttctaactgtaacagccttttttcttgccatgtaaagaaagacttctgcaaatgttattttctttctatcaatgaaacagactttgaacctagggctatgacagtctataaactagaaaacaagaggtatctccaagttctgatgagaggagagttgagggctactatctggtggtttaacaatgaaaaccaaaccatgaatcagatcatggcaccagttagcatttattaatggagttatacattcttggcttctcagggcaaactgctctgccacttactaattttgtgtcctttggtaagtaacttaaccgctctatgcctcagtttcctcatctgtaaagtaggactaataacggtatctacctcaatagatttttgtgagaattaaagagtatgttcacaaagcatgtttagaacagttcctgacatataggtgctcaatagatattacctgttgttttttaagtagccactgtatgttcagaactgtgctagatagtttcagaacatgataagctatggcccatccattcaaggaaattaaatattgttggagaaataacactgatataaaacagtatgtctgtatgtgtaacattttgtaggacaggctgtacatattttagatactcagagaaaagaaaaaattatgatagtttgaggacttgaattggccagaagagggacctgaagcccagacttgggtgattttcagtagctgaagaggattcgagaggtgatttcagtttagtagaaagaaaacgtatttaaagagcatgacaaagctgacatatttgtaaaacagttcagtgcgctggactggagatactgatctatatggggaagtagattcaccatttaggttagaatccaaaagtagtaagcattggaggattttatagtattggaaatattatgaatgatcagctaataattcatagaaataaagaaaataaggaaatttttaccatgacattaagtaatatcatggtaattaaataataattaaatacatgctcgaattaggctgaagtaaattttgcgaacaatttgcaatgactgagaaaaatcacagataaaccataaagggaaagatcttcaataaaatgaatggagattttgtaatgagcaattagaattttagctcatttggttcatagaaacaccagcagcagattgtgtggccacgtgggacacctcggctggcatcaggctacccgggactatgctagaggttgtaactaattgtgatgtggaaggataaaaaacaaaaccctcaaggcttcagggaacaaatctcatgtatgagaacactcccccagctaatccatggaactatgttactatcaaccccaaagtataatttttatttgttgtcttggaagctggaagcaaattgctgcagctgaggaagaaaataaagaaaagatgaaaaaaaatacttggataaaacaaaaatcaatccaagatagtggaaaagaagatctcatgaaaataaatttagatctcatgaaaagaagatcttatgaacaaaagtagatctcatggcctttgagatctatgaatatgaaatttgtaatgtggattaactgcacactcacacagatgcacgcacacacacacgagcagaaaaaaaaaacagaaaatgaaggcagagaaacatgaacagcttaggaatcagagtttagtgatagtcttttttcctactctcaagtactttacctttccactgattagcatgagtacatccttttctgcctttcttacaggattactctagtcaaaaatggaatactaaagcacttcacaagttgaaacagctttctaaaaacagagcagcagtgttattgaaaatggtttaaattgagaataatttcaggaactaactaacatttctggcatgacacccatctcacaaacaatcctacgatttaatgtagataacaagcactccctttataccaaaacaattaattgtatacttatccatgttataagaaaagcatatttagcgaaatttcatgtctaggttatctaaatctttggcttacttgtgttatttttacccaactacaggaacactgtggatggtttattatataacaaaaataggaacagtttggcattggtagggtatttatagcaagtggaacactagacttttgaaatatatgaacttattacttcagatttgtgataagctatttatgcatcaacacaattgaagtggtcagtttgttagatcttttgatatttaaatttttccccagctccacagggcataactatgtctcttatttgcttcggttaaaaataaacgatttcttaaaaatagtggcaaaaagcagagaactgccttaggatagggctccgagtggtacagacatctcactttcccactatccctcctataaatcccttactgtaacaagccctcttttttttttttttattatactttaagttttagggtacatgtgcacaatgtgcaggtttgttacatacgtatacatgtgccatgttggtgtgctgcacccattaactggtcatttagcgttaggtatatctcctaatgctatccctccccccaccccccaccccacaacaagccctcttcctttccattttctctgtggtatagttcccattccctctttgtctctgtgacaattgctagtggaataaattgggaagggcatggaaaaaaaggtctgtttcaatattcttttcttacaaatctgtttacacacattattattttttccagaggacttatccacatcaaatataggaaggaaagacagtttaatcttggataggacctattataacaattcttagctatcattttggctgcattgttccaaccaggcaaattctctctttagcttaggatttaaaacaattaaatagataactatgcacactggacactttgtactcaactgttatacttttacagtagattacacaaagtgtaatttgtgtttttctgaatttgttgttttgcacatgcacacaaaatgaaatggattaccatatttttttcgttttgaaaataaagagtttactgaactatacactgcactactcttttgaaagccacattacagacaaatccaaccttgaaaggaacaatattaattgaatggcaagttttttctctcatgcttaatgaaaatctgcatattctatatgtttatttttagaatttgggctgtttctgtacaataaagtgaagtagaggatataaaagatttttttcaattattcaataaaatatttgcctcaattttaagagatattttagtgactgcttcaaattttattgaatttgtagacaccaaacatttagaaaccttgtactgccagtcaactctgtaatgagttattgaagggacagagaaggattataagactttttttctatgacaattaatacacacaaaatatttggaattttaaggcatgcactctagaggtttaatcatttctttaaagtatcaagtctaaattttgataatctgctacttgttgaaaagtggatgctatttacagatgcatgggtccagcagttcattttttttttctgatgtggattacggagagatacgcattcaaacattaaataaagatagctattttttttaaaaaaatggtagtgcaattgcatttcatttcaatttacttttctattcaataaatacttatgtgtctgctatattcaaagcactgtcataaaaattttggaaatgtattgataaatgagaataaatgtatatttatctaattctgaaagtataaggaaataagcgcacagcacaattaaaggacttttgaagtttagtggagagacgagaatatttttagtttgggaagttgtgaaaggtgatattagaatattagtgtgatttatccattcgcgatggaagtgggagattaattccaggtagaggttatatacagagcaaaggcagaatgtggaaaaggacagtcaacatgcatggaaatgtgtgaggttggttggattaaaaagtctttgaaaggaaaaagctagcggggctgtgttgcttaccttttctaaattttcttcatctcttagtttttctcatcagtgaaagacgaaccctagtttttatgatgactaaatgagagaatgcatattaaatactttagcatagagatggtataaaataaggtctcaatgcatttggctattagctctgtgttggaaaaatgctgagatactactattaaacaaaggactggaggagggataagatggtatggaccctgatgactggggagatgattttccaacaacgagaagggacatagagggtttatagtatggggaggggggaagatattgagttcaattttatacatatttgaaaggaatggtaggacatctggatgaaatgatcaaatggtagttaagatagaactggagctcagatttagagattatatatggagattatatatggagattatatatggagaaggagtagaaaaagagaagtaaggaaggagaatggcaggtaaaatcaaagacagatgctgagaaatgactatatttggctttgggaaaatgaaaaggagtcagatgataataatataaaagaagagagaccagggaatatggtcataggagccataggagcacgggtctcaagagggcagtggagcagtgatgaacactagttaggaaaaggataagacatagtcctgttgcatatgtaccttgactgcatacggaaactctggagcttctcatcgttttctttcacaagtaccatccattgttcttactcttctgactagctatcatgtttaagtcctgtctttataacactgaaacttctgttactgttggagacttgaagtcagggaatatacatttctaacaagcagtgttaagtgtgttcttgccactgcatatttgaaaaattctgtgtattttctcatggaaacaatgtacctattagtcaaggtctattatacctgtacaaccagatatacatgagttgccatgcactttcttgagctggccaaagattgtatatatttatttctaagagaaagattttcaaactattaaactttcttagagcaatttgatttcacaatgattttaggattttgttcttttaaaaatgcctgtgtcaggtgatttaaagtgtgatgtgtatactcagccctcctcatttagtctctgcagcatattcataagttatcaggcaaaaaatgcaaaaaataaaaatttgaaatctggtaatatggtattttcacagtttcttataaatattatgataaaattcttggttccatagaaaaagatataaagagataagccttgtttatgaatacagtataataacattttagcaaatattttagtagtccttgttaatttagaatgtgtggagatcttgaaattgtcaggactttcaacttgcctttccttgtttttctttttcacctgctggtatctgccccacattcatctgaatgtcttttttctctgaacttgctctcttcagactagtactagtaagaatttcacatagccatactgactagtaccggtggaaactgatgacctccggtatagtgccaagtccttaaatactttccagctattctttttaagcctcccatttttcttttcaactgtctgccttaatacctacttcttgtcccttaacagataactggtcctccttcattacaaaggaaatagagagcagtaagtaaaactgtctcaacttttgttctagttattccagttatttccatttacctcaaatctgcattctctttccattttccagagaagaattatcctctcttctagccatggattagatttctctttggttctacttatttcttaattcatcccccacttccacattctcatgttggaatagaggggtaaactagaaaaaatatctggagccttttaaaggactgttgtaggggagaaaagatttcttacctattgcaggattcacagctgagatctcctataaaataaaagatagataacaagagaaaagcatgtgaattaaattttatgtgacacaggagccttcagaaaatgacccaaagacctatggaaaactatatgtttttatggacagtattgcagaagtatgactggaagatgaaagggtatgatctacttgtttattcagtacttcttggactctctgtgtgatgttccttccctttggtatagggcaggacactcgccacatgagagtcttcagcgaagaagggagggagaaggtcagacagtgatcttcctaggctttattgtctgcttggtgggagaaggtcagaaagaccttcctgcttttgctgttttcttaaatgccaaggtgccctatttgggggtggcatttcctgtaccccatcattgtcaataaattacatgttctctcctgaatctttgatatttccttctctacttgcctttctctttttgcatagaaataggctcacttctattaaaaaccaaaaggagcactgattcctcattctccatgtatcattctcctcaaagataaggtggataaatttctcaccttatttgatgactgtatacttctttattctctttggaaacttctcccttctttggcttttgtgataccattgttcttggattcctttttctagttactactcaggttcctctatttgttctttaaatgtacctttccagagttgtcactactgtttatttccttcctttcgctgtacactctcctttgggagttatacattgatctttaatttctatggagatttctctttcaagagctttaaacccatgccattcaattgcctagtgtatatttatacttgagcctcccccaaacacctctaatcgaaccaataaaaatgaacctgtcaatgtccctttaaactgttatttctcctatacttactttctataccacaatttcccatcatcctctacctgagaaactccctaatcatcccatattcttcctctccttcactttctatatccaacagtgcatgaagtcttactgtccatccttcagaatttctgttgagctagttccttgtacttggcctccccttcttttccctttatccctttcaccaccactgaattagtctgagtccatctcatttcttacctcttaactagactttgtctttgtgatttctgttctccctttaagctaccatccattcagtgtcagggaaattatttaatcatgtttacatacatttacatgatctttttactctctgacttctcattttctaatatctctccgttattttgagaatataacctaaatgtttcagaatcgtatttaagacccttggcctggcctatcactcttccctatcactcctgccctcattccataccttttgctgaaccaagcttggactcagtcatttgaatctcttgaagttactgaacacatcatgtcttacattctctttgccttcattgttacttccctctctgctcaattttgtcaagttccacttgtctttcaaatatgacttcaagtagctgctactccagaaagcctcttctatcaaccgtctcataccactacttactaagcattggctctcttctgcttcctcaaacatttcctatcatattcttgttgttgttttctctcttcctcccagacccatttttaaacccagcctgcatctccatcttttagtgtcttttccagcagttactagtacttgttgaatggattaacaaagaacaacaatgaattcttcctaatggagtgctatgttagtttcttattatgtgaaaaagctgtatcctctgtaatttcccccaaattttatagtgtcttctggataaatttaataaaacagtgcttagcgattacatatttgtgcttgacagtttaccaagaaagagaaagattgataaaaaatttttgctcatatgagtgttttcccttgagtaattttttactttcatgatgaatgggacctttccttattttctattttttataaccttttaattccaggttgaaaggcagagtgcctaagtatttcagaaaaccaagttaacacctcatatttataaaaaataatccttgctcctataaagtgttcctaacagcttgtcagtggggtagggaagactggatgggttctgaattgcttttcagccaaaacaggctcacctaaatgaacactggaagtgacagtgcacttgtgtcaagttagaatacatgttttgggtcagtttagtataaatcagaattcagggatgagttaagttcacttctttacatatatattctttgcctctcagtttcgagctaaagggatgtataacgtgtcttattatttgtcagtgttggaaattatatttgagaagagatgactcattttttgtaggttctaggacttgttcagcacctgcttagagaaatgagatagtctcatctaaattaggaaattactggatcaatggtttttgctcctacctgtaccctactataattttttgtatttaatataaaaatggggcacaactatgtttactaagaatatttacttataatatttttcaaatataggcaccagctaataagtagcactagttaaaatgttattataacaatttttctctattttatacattattcccttttatttgtttttgtttcttgatattcatttacctttttctatcctgttcatacagcgtggttcaataagtattcttccttattttcatatgtgctaaagtattcctagttttaatgtattccatttagtaactagtttgtttcatatgtaagtcaagcctctgtgttttcctctaaggcatttcatccttttttataactggctttccatttttttctttctcttatcagctcatcattcttttaaatgctctcttacatgtcatttaaatctcttccatgttatatttttattccatattttgttatatttaaatttatctgaaaaaatatatatttatactacttacatttatattttaaaaaatttatatttatactactggaattcttccctaaggaagagaagacatacacagttaaatctccattattgaaattatatatagatatgtagagaaaagttcaaattcaaatataaatcatctagcattcttactggcttactaatgtttctttacaattgccttggcaaaaaggaatacatgctttaggtctacaacctgaggaagaataagtgaaatatatggaggaatacaagttaaatgattttaatatgaatggggaagtttgtgtggttctatttggtaatatctctcataccaggaaaaagtgagatagaacatggatttagggtcttctaaaatatcctgacatccatagcttatattttaagatgtccattgcatacctgaaaaagatcaatccttcgatcataattgtaatgatcaaaactattgctttaaaatttggatccagtaattccagtaattatttggatctagtaattccaaattcagtaattccaaatataaatggatctagtaattccaaatctaagagtctagctaaggaaataatttttttgttgttgttgttttgtttttgtttttttgagacggagtctcactctgtcgcccgagctggagtgcagtggcgcgatctcagctcactgcaagctccgcctcttgggttcacgccattctcctgtctcagcctcctgagtagctgggactacaggcgtccgccaccaagcctggctagttttttgtatttttagtagagacggggtttcaccgtgttagccaggatggtgtcaatctcctgacctcgtgatccacctgcctcggcctcccaaagtgctgggattacaggtgtgagccaccgtgtctggcccggaaataaaatattcttaagcttcaggctctaagatatttgtggtggtgtagtatgtagtggttaaaagctgatgatatcttaaatttctctttaaaaaggaggataatcaagtatattatggaatatagagataatggaatattaagtggccattaaaaataaaatgtttacaaaatgtaacgtcatgggaaagtatgtatcatatgttataaagctaaaagagatatgcattttatataacatactttcaactatgtgaatgaattttaaaacactagaagggaatgcatcaaattgttgaatgttccacctggctggtggaattattcttgcattttacaaatggtctgcatttagtatgatcttactattatattcagaagacttgtaagctaaaagataaagtttgtagtttagaatgtttaatagctatttaatggaattttaattcaaaataagcaaattgtttactctccttggacaagacatcaatgtcatttttctcctttgatttggaggcatttcagcatcctgaaagcctgcacactaaggattcagtgcttttgcaatttaaagctggagtggaagggtggacatagtcggtgctaggagggagaggaataatttaagggcattttaatgaattatctgtagcgtggatataaaatatcagcatgtgacttttatttgccagagatctgatagaacataatcttttctgatttctgcagtatcaaatcatgggtggataagatgcaagaagaccttgtcacactggcaaaaacagcaagtggagtcaatcagcttgttgatgtgagtaaaatccaccaaagagatttcttaatcttttcattaattcgaatgcagttctatcttctaggaaactgtgtctctatattacaaatgggatatgatttctcatgtggatctggtggtgaaattctgagagaaaccattggtactgctagttactgtgaacaggaaatgccatccttagaaattaaggaaactttctcagcacactttgcagttgatacgtaggtctcacttaagtgagtctgcgtgttatgtatactctccgtaaatttaaatagggaagtcatgtacttactattataatgtttccattcttcagaatatatttaataatccctcatacagtggtgacttgaactcctgtgatggattcttttgaatatcctcagtgaaaacatatattcattctattagggtaaaaattatttgaaaagtgtttacaggcatgtctagagattagagatagtcactgagatcagtaataacggttctggtgcaagataaggagactctataaaagacgatttttcttgtgacttatgaattagctatgaaagtcactctaaagtgatttttgagtgacagcaatataaatatttgtatggcatcttaactagattattttccatgggtaagagcatttacatgtataggttctgtaagatttattaaaaattaaatgtcactttttaagggccccactactttcgtttcaatgtaaataatacatttgaaaatattctcattttgtgttgttagtgatgcaatgaggccttttattttccaaaaatgtgatgagtcaatgagataaagtggtataaaagcagcttcatatatagcatgactttttatcatgtaaatatatatgagaaactggaatgtgtggttactttatgtattaatagaaattcttaaggaaaccaaatacacacaaacttcaaaaaattataccagaatctctttataaaacaactgtagagagtgttgaacaaacctaagtgtctgtgagataaggaatacgtttggaaatgaaaggtgttccctgcgaataacaatgatcagatttaattctagtcagtgtattatgttgagcacgtaatatgtcccagacactgtgcaggctgccaaggataaacaaagaaacagtattcctctcctcagagaactgacactctgttgataaaaaaaaaatctcgattactagtgcaaagaaacttgaaagttattgtgtgccgatgcttgggatctgcaatgattcactgtgggaaactatattagaatatgaaagtgtgtaggtagtaagtgagcctctatgaaagtcatggagtttatggaagtaccaccaaatcttctttgttaattttcatttagatactatttaaattgagagcaaagattttatttaatcataatgagaaaaaaaagaaagtacaggttctggtgagaagttatatgactgtctttatcgacagatggagattaaaaataagctgctcttgggagcatctcccttactctgtgagtgcttccccagccttaaaaaacaacttgcttggctggcctcattgttccttttggtgttaatatgtgaaactttttttttctgaatctgcttttttgcaatgaatcattaaccaaaaagaattttcacctggtttctattatgctttatgaaggatagattactaagaagagtatagatattgatgaattaatcaatgactgaattaacataacaaaatagaatggaaaagatgaaagaaaatctctaattttctgtttatgggatacatacctcattacggtcacagaaaaattccaaattaatgaataatgtgttaggtaactggggtggtgggaggagtattagagcagaattcattattggaaatagaatttaagtactagggcacacaaagagtgtcatcttacacagacagatgattccgtattgcctcattccttttgctgaaggatgtcagagtttagagtgaactttgagctgagattgggggtgttggatatatggtgaggaccagaagttgaataaatacaggagcttagcagggctccagttagaaatttattattgtagaaatgaaggttcttcaaattacaaattacattcatttttattggattcacagggtacaattagctttttacatgaaggccaagaaccaacacaggcaccacagctaaagtaatatatttttggtgatcatgccactgcactgcggcctgggcttcagagtgagaccctgtctcaaaaataaaataaaataaaatagtaatatatttttgcaatttagtgaaaattgctttattgtatcctaaaatagtagcccatggaaagttgctaatattattaaatacattcagtgcttcaactttacaaatgtgagatttttcccaggttacctgcctgtcttctgttaaagatcaagagtgaataggtttgtttaggactattgtccctgatgcattagacttttaagatgtctcttattggattattccattactgaaccatttggagaatacatatgtccatcagttgtatatgctcatccacaagatgggtaaaataattgagagaaggttaaaattttgttctaagttacacaactattaaattggatgcaactctgaaatttgaaacaccttcttgtatgctttagaacatatgttaatagcattttttatccttatttgtaccttgaaaacataagcaaatccccacataaacaaggtgagtatatcagattatgctaatgctctttttataaaagatataaattagaagaagccaaagctctgccactaacaatgatctactcttgaatatttccatttgattttttttttcaaaaagaaaagagtgtaaggaaatgtcaacatataatatacatgcataatttaaaacctcccatttctgttgatagcacagaaatggtttgtttgtatttccattgaaataattgctaacaatggtacagaaagtaagttttcactgatttttttcttcatggtcttctaactgaagaaaacccataatactttaaatggagtattatagcatatccctctgaaaaatccctaaggctattataccttggttctgccaattgccagctttaggatctggccaagttatttaatctcatggagttgttgggattaacgatacaatctgtataaaatatttattgacatatagtgagaactcaacaaatgtcattcatttgtcatattacttggtgacattgtataagctggggtacaggctgggccagtatgacaaagatacaagctaaacatgtatttttctgccacatagcagttgagaggtaagccatctaggactggcagggtgactctgccatccttagcatggggcttccatgcctgggtgcaaaatgattcttccagttgctcttctttcccagctgtcatgtaaagggaaagagatttggagagaagatatccagtcatttaagagtaagacattttgctcacattccagtggttagaacttagtcacatctaactcaaaaagtgtcaaagaagtggagcctttttctgagcagccatgtgccccactaaaattctgtcacaatggaaggggacagaaccaatagtggaggacaagagcagtcttcacttgtatgtattattatctgaatatataaaaatgtattaaagctgtattaacagagatggaagctgtatttacacatttaaaacattttagacagaaaaataggaaaacagtccccaaatttagaaaaatatatatgtatttttaataatctgaattatagaatattttgaaatatatttctaaacacacacacacacacacacacacacacacacacactcctttagctactgcactggcaaatggcaaggctgatcatcacatatttatgaatagataacatttttaaaaattaaatagtcttaatattcctgtaaacaatgttttaaagttaatgaaatgtttaccattgccatttgaaatggtgcatgtcacattgttgttatgaagctttcttcttaaaggtaaactgtctgaatttctaaaattttaggatagcatctgcaaatatgtttagaataatgtgtggattaaatttttcctggaagcttatttttgaaggtaggcccattctacagtggcattgccatagaacttcctggcttttgattcattgttaatgatttattaagtgaaagtttcaaaaccaatacctttacatttcaatatgctactcaaagatgtaaatatgaaatgtgtataaatattgagcattcaacactctcaattaaggtagtatttacataagcgttctgagtgaagaatttcttttcattagtaattcagactaatgcttactctttgacattgtggtcatgtcatctcatgtaaatagaatattctttttctaggtggcggagagtttaatatatttacagagggagatactcaaaaacagagcacaattaatcattggtgatcctgactagggaatcagcaagacgcgcaggcaacaagaaagatttccgggagtgctgaaagaagccatattagaatatcagatattagaattccctttacacaattgttttgagggtaaaaggcaatataaaattttaaagaagttatgtgctttctcactttaaataaacaaatacagctatttattattaattccatatgttttgcttttattcagagttgccttactttcctcaacaattaagtgctgtaactaaatcagcaccataacgatgtaggcaatttaaaattatcttatactcctggatttgctctttttgtcctaagtagaaagaaatctattttgactgcagaatatagcactataaagaatgcagagagtatggtttcccttcaccatcatcctccccctgcctccctgctgcactggagttttttaagtaagaagctatttttgtttaaacagtggttaattacattcattttcaaagacacagaataaactcaggggatttctaattttagggtgactttcaatattttctcaacagatattaaaacgttttttcttttaccttcccattctcttccggccgttaattaacattttctgaagttatgctagtacttgagggatatgttattatttattgttactctaaacatatatttagtgcaatggttctcagccaggggctgttttgtgccctggcatacatttggcaatctttggaaatacttctgattatcataactcagggcatgggatggtatggaaatacttgtgattatcataactcagggcatgggatggtatggaaatacttgtgattatcataactggggccatggggtggttgctacgtgcatactgttggcatagaggccaatgaggcttttaaacatcctacaatgcatgagacatcccttcacaacagagaattatctgtaaaatgtcaattgtactaaggttgaaaaactgctcaagaagaactgaagaatctgagtgtatgaaattctttaaatgaatataaatttgtaaaattgtgtatcagcattggtacatatcagttttgctttagaaaagccatttgttaataagatatgacagttatgggcaaattaaactgggctgcttttaaaaattgttttattggcagtgaaatatatttaggtcgtttggggttagagacattaaacaggcagctcactcagcctatggttaattatttttaaatttagttttaatgaatttagtatgatctttttcacttctaattgcatatgaattttctggccaaaatgtgtattcaaatttatatatagcttcagatatggaaaaagagaggctaggttaataaattatctccagaattaaacaacgacaacaacaaaaaaacaggtagagagtttctgttatttgtgtatgttaatgttttccttgttttgaatctaagtattcttaaacatgaacttaaaatttactttttgtgtcaaatgcgtttatcctaaaaaccaaaaaattctttagtctttgttatagtttagtttttctgttctagggacaacctgcacttctggttaaatataatcacctgttctatgtataacatggagaaaattaagtggcctgtttgcgattgtcacttgttcttttctttcttctgtctttaatatattgctcggaagcatcaccatcgtgttcttgttaataggagctagggcgagtagcagtgtgtgctgcagaacgctcaccaattgtgacttcattcttcctaaatatccttctaaagacgatgctccatttgaaatgctatagtcctagctaagaagctgtatcacagcaaatagaaagaatagagtggctagggagactcgtgagtttggtattagaatgctagtttgatatagttatcattggaaaattatgcactataaatttgaggctatgaccaaattatgcatttatatatgtgtgtatatgtggtatgtatataattgcatgtgtgtgtatatatatgtttggattgtgtttgtagtaaacaaatttataattcagattcttcctatgtactaattgctgtgatagccactagaagttctgagctaggtagtttactagtctaaaatatgttgggtagactagagaataagatataaaccatccttttatatgaaggatccttttaccatccttcataattatgtctcaatttgcctttcactctttattttcccataactccttgtattacacccattctgatctctttcatccattactgaatcacgtttcctccaaaacgtggctgtagtttcatttatgtgactattgcatcctatgtgatcttaatttcctctgaattctgacagcatacatttctatatctcttcattggaacactcatattcttcctcacactgatcattaccttaatttgtgtatttattctattgttggaatttaattattgtatcggtgttgtatttgtagtctattatgtaactgcatagcatcttacttaaccatgatttttttaggtttaaaataaatactgattttaaaatacagggaagaagttgttataaatcattattcacattcccagcaaagcctgacagagaatcagtatccattcactaattcatgcaattggtattgattgtgccaggcactgtgctatgcgctggttacgtaccagtgaacaaaacagacaaaaatctttgtcttcttgagatttaccttgtggtgaaggggaatagaaaatactcaataaacatcacacgtatataaattatatatctttgatgtttgcacatgcttataagtagcaaaatagaaatatcaagtcataaaaaatttcaaaggtagtgtcccaattcaaaaagctaggttatagggaaaagaaaaaaaaggccataatttacttagagtgaagatgcagagaatcaaatgtgatttttttttttttttttttttttttttgagacggagtctcgcgctgtagcccaggctggagcaccgtggcgcgatctcagctcactgcaagctccgcctcccaggttcacgccattctcctgcctcagcctcccagatagctgggactacaggtgcctgccaccacgcctggctaatttttttttttttgtatttttagtagagacgcggtttcactgtgttagccaggatggtctggatctcctgacctcgtgatccgcccacctcggcctcccaaagtgctaggattacaggcgtgagccaccgtgctcaaatgtgatttttaaaaatgacattaatacagtgtcatgcatcttgtaaaatgattacctatagtttcataaatgcacacactaagttgaattaatacattttagcagttggtatttgcattagttctttacccagcagccctaaacacaatcgacaatatgctaaagagtaagacattttaaaagcttgatttttatttagtagattacatcatttattattttaatcaaagggaaggaagaggttgaagagatcagggactaattagaaatgattaaataatttttatggcaaaattcattttgttaaaacagctaattttcatggggaaaaggaggttttgtttgtattgtatttgttgttgttaaagtatattctaacatcaattcagatctacagtcactagttactctttaccttaggtgaaggaatcttcacatttctcaacatttctgtgtgatggccagcttagatgatgaggagacttatgataaagaaaaaagagacttaatgatatagaaaaatactacattagtatttgtttagttaagggaactttgatccttgaaagtgaccgagaaagtacattatatcattcttttctgttaatacaccttttagaaagaagacattcttagttgctagggaacaagtagttcgaaagcccaaggaatacttaataaaggaaaaaaaaatgtataacccacagacaaaccatcccacgttgcaaaattcaactaaaattaagtgaaattgattttgtgggtatctgaagcagcagaggtgacaatgaatcccttttcttgccttcattagtattgaagatattgaatttactcctgttacccaatagagagtggaattagaatgatggtgggaaatataatgtaacactttcttttaatcccacttctcattattttgaggtaggatgatatttatttatccagtttgtctagttttatacaatgtatgtatgtatgttcatttcgatatttttagcttttctgtcatctttcttcttagaacctcacacaattgtgaaggtaataatgggtatccttgaactaatttcattatttcctgatgcctaatggaaattgtatgttgctcacaatggagctcatctttcatattcatcagaatctaatgataaatgaaatgaaaatgcaaagttataataaataaataatgttaatcacaacttcagacatgggattctgttagaatttttcattattaggaatagtgaatcactcagaaagtttattatcaatctacttataaaaaaaaaaatagactgggtgctgtggctcacgcctgtaatcccagcgctttgggaggctgaggaaggaggattgcttaagcctgagagttcaagaccagcctgaacaacatagtgagatcctattaaaaaaaaaaaaaaacaaaaaacaaacttagccaaattaagcgaactcaggaggagcctggctttcagcaagaactcaagttatttagaaaatagtttggtcagaggaagggcagttcagaggcaaggcagcctcagaagctattattgttgactctgctgggagctcttcacagctaactcattatgttagtcttctattgctatggtgacagatgactaaaaacttattggtttaaaacaatgcagattcattatcttacaattctggagatgagaagtcctttctgtggctcatttctccttcccttggtcttcaaagccagcagtgttggcctgatttcttctcatgctgccatttccctagtttactcttccttagtcacatcttcctcttccatttttaaggacctttgtgattccattggctaactctgactatctagggtaatcttcttttaagtccagctgattagtaaatttaattccatctgcaaacttaattcccttttgctatgtaacaacatattaacaggttctggggattaggatatggatgtttgggaagccattattctgtctatcataaccaccaattctattgctcagtagatctgaatactgttttcctcccactagtctcttcagttctacttctacttaaacctttgatccatgctatttcatccaactgtcatcttgtggtgagagcatctgattggctcagtgcgttatctttatttatacaggtcttttatatttggctcgttacatgccattgactcagaagttaacttcttgcaggtctaatataagtcctgatacaattggttagaagtcaaagacaaggccatacattagaatatttctagccatgtgtaagggagctcctatttcatcagggattgtcaaagggaaaatgtccctcagaaagatggctgtggatatggcagaaatcttgattgcttgtccaagacaatttccatggaaggaaagtacaggtgcaagtattgggaaatggggttgtcaaaatttacatacctaagatttaatatgcagaaatttgactgtttctctttagggaacttaacttgcttatgagctgacattctctttcctaggagagggaaaaattaatctcatcacttgaaggttagcctctttcagatcaaaacagccttttgtggtcaactaaggatttagtaagttctaactctttttctatattctctaatcttctttactttgtttctccatgcctgggcgcagggagaaacttatatgacaaggtatctggtgtatttgcttgcttttgttctcttgatatagatagtgaacttgactgctacttagaacttggccaatcttctcaacctgcttagggcccctcagctgtaggtggttctttaccattatccttcagctgggtgtctgcttcccactttccatctctcagcctctgcattagaatttctttgatcctgcacggagcctatctcctagcagacataccgacccttgttcctttcttgctcatttcaaagggctttcttaaatttccatgtcctgctgaagccaaggaagatttaggacatagaatggcattgaagattcactttgcctaaatatgccacattaccactcaccttcggctgctctagacattggtttgctcttttatgatgaagtgtgattcagactccctccagatattctgaagcctgaatcccattgttctcactaatacaatggttaattaaatgtatattatagatttcttaaagtgaataaataatataatgtatgtgaaacacctgaaagtgatatagagtagctgcctacattgattgctaataatgatctagctgggtgcagtggcatgcacctgtagttccaactacttggaaggttgacatgggaggatcacctgagaccaggagtgctaggattgcctctgtgaatagccattgcaccccagcctgggcaataaagtgagatctgtctctaaaaaacttttttttttaaataaaaaatttaaaaaatttttacgtcctctaaaagtttggaagcatatttagttttgagtaaatatttctggggcatctgtattatgatttccaagaggtttctttaggaattttgttaagcaattatatcattgagtaatatcattttttagatattaaatttgaagttattttaaaatgtataattgtgatgattatcttggaactgtagacttaattagagcaaagtgacttagaacatatattatgttaacatagctgattagcataattaacatatgttaattagaacaaagatatttagaacatagattatggtttttttggctatctcacaaaccataatctaggttgtcatcacagagaaacttggtctttgaatgttacaatgaaagtacattaaagccagttggttaagattgtaggaaagaaagaatgtacaggtgacaagtattctttttgttaagacttatgtcagggtggcagcaggagaacttcaactttagggaaactaaagcatgtgagtgtatcaggaggaaaagtatcctgtttttaagtctgtctatatgctacattctttctagtagagaaaaaacgaaggccagttttgcacagcatgtgaagagttgacaggattgaaatgtaactctgtctggtgccaaaaactcgtattatttccaccatgctgtttttccttcgagaaagaaattggacaaaatggcaaagcagataattatttacaaaacagtaaactgaagaagaggaaaagatacctcaagatatgtttgaaatattaatatatgaaatattgtagaaatatgtcttagtgatggaaagagttagaaatatacacatattatgaaaatatattgtgtgatcataaaaatccatatgaaaccttctattctgaaaattatttactaaacatatatcaggagagctttgcaatagctgtcatgacaacaaagatgattgtagtctttggaaccagaagcaagagctagtttttttggcgggcagttatataattttaatttatttttattaccaaagaaagcaattcaattgtggttttatatataaaataatacagccagatatttacactaggggttctagactttaacttcttgacttaatttatttcacatttatttgtgagttacatcttgtttttgttaagtatttaaaaattatcctaaaaggaaaatttgagagaatataaatttatatatttgagaagatacttatatgcttgaaatagtttctgctgatttataatctatttattccttaaagcaccaagtaattaatatgtccggcacatgtatgtagagacttaataaatgatattacctgaagtatagattgcacatctgaactaatccccaccaactatgaagcatattgtattccctataccacaggaaggaggttagactgcatagagaaatgaacaaggtattaatggtacaatgcacactacatttcacaccaattagctctattggttttactgcaaagaactacatatcctggatcaattaaagtgatgttgtggtttatctgtttgtacctcaaatcaattaatcaatgttcctaaatcttatcttagtctgaaatgaaagagaaagctttgcattggatgaagttcttcatggatgatatgggtctttaaaaaacagaattcaataatctgcttcttagcagaaagcataagcaatccagtaaaatgcaggactcctggatgaatccaaatatggagattttatcactaaattaacgtgccttgagtactttgagtgaaaacttataagttcaaagttcacatgagtatggtaaaatctcatagtgtgaataagtcacttttaggagcaaaaattgatttaaatctttacaaaatattaattttaattccaataaattttaatttcaaattaatttttatttcaaataaaaaattataagtccatgtaaaactaatatgctctgtggtcaataaatgttagtatgtatctgtgtccatttgaagccagtattcaccagtgttatcagtgcgcagctgggatcatactgtagaacctgttggtagtaaagcagaatgctggagttgtgccagaaaaaagcagggttgaactgattcctgtatgtgcctggattcacttctcataagacagtaaaaacctgccaggtcctggctttcaaagatggtttagtcatgcatgtgcaccccatctgttggatgcatgagggatttccttctcatctcagccctccagccacaaacactgtgactgcttcccctccaacccccctttctttaattcttcctctcctgctgagtgtgtacaggctgtgtaagacaggtgcaacttatgccactctggggaaatccttccatagacactaaggtgagccagaaaggtagtcaaatttttcttttggcacctagcttaaattcagtatactttaattcagtgattaaaaactaacagcaacatttactttgattaaaaaaaatactccattaccgttctaaccaaaaccttaatgaccttcatctcttctatatgtgaactgtctcctaagctcctcttgttatctagatgaatattagcaggggctttatatgtattctctctctctccgttctgtagcacataacccttcctcctgcctttgttttccacactcctccaggtttgacctcccatgctccatttcgccttctgttgtctaggatggctaccctttctcttacgatgctgatgacagataatacccagtttcgagattggagagtgcagcatcaagcctcaaaattgcatgtacaaaccactgtggtacaagatgttttacaacctgttaacataacctatattttggcaagctggtggtcctagagcaaatttatatttacatattttttcctgacacactcaaactccaaaaagatcaagataaagaacagggtggtgtttctaatcagttgtttatagttttaaatacattccaatgggaacttgtaagccaaataagtaactattgttcttactagttttttttttctttcacacagatttatgagaaatatcaagatttgtatactgtggaaccaaataatgcacgccagctggtagaaattgcagccagggatattgagaaacttctgagcaacagatctaaagccctggtggtgagtttaaattggatctgctcattttattattttccttacttatctattatttaattttcatgctctattgaggggttttggtatgcgttcttcttcttagtaactgtgttcatctgatatgttcataaaaaatgagatatcatggtttaaatgcaaaccccaaaatatttctaattatgtttattttatattactattatattttaataatctgtgtttaattgattatatgtatatgtatccacatgtacatcatgatacataataataaattgaacatgtttaaatccatatgtacatcatgatacataataataattgaacatgtttacacaacataaaacccagaatattatcatcctctttagttgtatagtctcttattccatcacccttcctctctgctagaggtggccaaaatgctagatattcaagttaccattttttttctttttaaaaatagttttccctcacaaaaatgctttgctaaacaagttattctttagtttgcttactttttagcattatcaaattcatattgcactgtatgtaatcttcagctacttggttttctccatcaacattgtgtttgtatgatttatatgtatgtttgcacttagatttaattcattttattcagttaaatattttatgaggatgtatctcaatttcttcatttagtctctgtaggtgggtaaattattatttggattattccagatggatactattatgaatagtgctgctgaattttcttgaacaagtctcctagtacttatgtgtaagaatatctgtagggtcaatacaggagagtagaattgctagattgtagggtattcgcagtcagctttataaaatgacaattgttttccaaaataatcgtatcaattcagaccttcactagttatatatgagcccacattgatacatattctggccgacatgtggaagtgttacacttcttaattataggcaatcaaatgggtgtaaatgttacctctgcttgtcactaatgagggagacatcttgctgtatattcatttacctttcttgtttcctcttcagtgaaatttttttgtacatttaaaaaattgatttgtaggttatgtattcctgatgctaattcattttagttatatatgatgcaaacatcttaattttattgcaaagtcaacttttcttttaattattagtattgtagagtgttttctttaagaaaaccttggctaacctgaggttatacacataatttatttcattctccatgattctaagctttgtcttttgcatttatgtgtttagtccacgtgcaagttatatgagtatataattttagtctgcatttcaaattattttttccaaggaatttttctagggcatttataaattagtttgccttcccctagtaaactccagttgtccagctcaatatctagtaggctgatgtggtttggctgtgtcctcacccaaatctcatcttgaattgtagctcccataattcccacgtgttgtgggagggatgtggtgggaggtaattgaatcatgggggcgggtctttcccatgctgttcccgtaatagtaagtctcatgagatctgatggttttataaaggggaattcccttacacatgttctcttgctgtcgctgtgtaaaatgtgactttgctcctcctttgccttccgtcatgattgtgaggccttcccagccatgtggaagtgtgagtcaattaaacctccttcctttataaattagccagtctggggtatgtcttcattggccatgtgagaacagactaaatacataggctaagtccctcactatattcttcttcagaataatcttgagtattcttaaacttttaccttttatctaaattttagatttggcatataattatccaggaaaatgtctactgggattttgatttgtattatattgattcagaccaaattgagaagaattgatatctttattatattttgtctttctatttataaatagtatctcttatttagcagtattttataccatttgataaactttaaaaatttttttcataaacttcttatacatcttttgttagatataatgctggagcttcagtttagctcctcttattctttgtttgtttttgagacagcgtctcacttcattgcctagcctggagtgcagtggcacaatcactgcttactgcagcctcgacctgctgggctcaagcagccctcccacctcagccttccaagtagctgggactacaggcatgtaccaccacacttggctattttttaattttttgtagagatgaggtctccctatgttgcccaggcaagcctttaactactgggctcaagtgatcctactgccttggcctcccaaagtgctgggatttcaggcatgagccactgcaccccgcctggttcctcttattgtgtagacttcagtacatttatggatatttatctcaatacaactctgaatttcctgtttgcttaatactcattgttcaggtttttttgtttactatcttttataaatatcttgaccctcaaaaattttctgttcgttctttctttctttctttctttctttctttctttctttctttctttctttctttctttatatttcttttttatttctatgcttcgtttctttctttatattatgcttcttcaaatatccaagatattgttgtagtgtagcaggtatgttggttggaatttttgttacaccatgttgctagaggttgaaacatttcattgaaaataataactgaggtcagatgcagtggctcatgccagtaatctcagcactttgggaggccgaggtgggagctgaggtcaggagttcaagatcagcctggccaacagggtgaaaccccgtgtttactaaaaatacaaaaattagctgggtgtggtggcaggtgcctgtaatcccagctactccagaggctgaggcagggagaattgcttgaactcgggaggcagaggatgcagtgagctgagaccatgccactgcactccagcctgcgcgaaagagcaagactccgtctcaaaaaaataaaaataagtaaataaataaataaaaatagtaattgagtaattcataggaagataaactttcattactggaaaatgaaaacattattatcttcaattttggagagagaatacccttttttatttaagtaaatgtttgtaataaaaacttatctaataaaaataaggtgctatctactgaagtgattaatattcaggtgacagtggaaaatgattcgatttatattgattttatcagtctacatttttcttctggatgtaggaagcaggtaatttggacatcatagtctcttaaaaaaggttgtggaatgaaatagtgtgtcttgccttaattggattaaaatagaattctattgagactttctttcttatttctcatttggaatggaagctcaagacacctggtgcattatttgagtcttgtgagggatcagtagaatatcttaagcacatgatgacagaatactgaagacacaatggctaattaagtgtagaatagttcaattttatttcagggagacagattcatgtttgttttcaaactaaattctttgcttaacttccttgattccacaaaaatataaaacattatttcaaagagaaatattttgaggctaatgaagaacatatgctacattgtattgtaaatgaatgcaagatggcattgttaatttgcttctattttagttgtaggcttatactcagggagacatctggattaaaggagctttatttcttctgggtgggacactaatgtaattttataggtaaatacagtggaaaacatcatgaatatacaaatctaaggtagatgataaaatttaataccagttaggctttattgagtggttactaagtagcattatctaattatttcccataataatactatggtagagacaccattattagtctcatttttcaatgaagaaactgggactttgagagttcctgaaacttgcccaaggaaatatatctaataagtaatgtttgccagtgcttcttaaactttaatatgcatgcagatcacccgtggctcttgttaaaatgcagatttttattcagtagatcaggacagagatagtacatttcttataagccaccaagcataaggtaatgcttatgctcctggtacaaagactatactttgagcagcaagaatgtgaaatttgaatgtgaatttgattgtgaaattcaaattcaggtgtgtctggcttcaagatctacattcctacttattacataaatacatcctttgacctaaagaagtgtataattatacaaaggaagaaatgaagctaagtagtattttgtaaagttctattcatccatgctgaataagcattcgatgatctagataatagaatattctggaaggctattaatttttcagtgaatcctgtatcaattaaccattttcaaaagaatgatttagtgaaagaaaatatatggtatttaaacaattttcatttttatttgagtttggaaaattttaaaaccttcattattcttcagtaaacataagatatctttgaaaatataaatgtaaacactgtgaaagaaaaataaatgtagctggttgttttcttataagcctactaaagaaattacttaacagtctttgataattcaggtttttgaaaaaaggaagttaaaaagtggagggttttttggtgaaattattgctttttagtatctgcagtaattgttattgtgcatacatgaacacagattttatgtatttgaagattaaattgttaatcctatcttttataatatttttgaataaaaagtcaatttaacttattgccttatgtgctagcttgtttttgtttatatgtttgactctaaactacttattgcaactttattttacactcatttgtgcttttgtcttttgatcagctccatctaccagccttatgaagagctgaaagataaaacgatatcaaaaccttttagttgctatctctttgatagcaattttgctttttttttgttgggggtgggggcttgttactatataaaatcatgttatgattctgatgactcttatgtattaggcccttacagaaactctgtgaagtagacacattaaacatttatacattcttattttataaatgaggaaattcagaagaccaatgttcttatccaagactgtgtagatagcatgaggtagtggtagaattcaactttatgacttctgtctaaaatccagtttgttcccctctaaacccacattcataatttgaactattttatttccaagatgtgtctgctaaatgacttttttttctgacatttgctacgtctatatctcaggaactggctccctgcaatgattatataactaatatcattggattattcttaagcaatctcaaatcaaacaatgttttgaagcaaaaaagatataatcatttaacattattatgaacatacatttcagcttgaactaggctgaaatatctgcaagtgttaatgaacaatttacaggagaaagcttttcaacaaagcaatccaacctccaatgcggccttctgagagatggagataaatgaaatctgtggtctcattgttcaccaaccagcccagccaaggggatctactcagtaaatgaaggtctctaggcattttgctcaaagaaaataggatcaaggttataataaacaaatttttctggtgacattttccaattatggcatattctgtctccctctggttgtcctggtaactttaattaaagctgctccaatctattttgaagctttaaatactgtaatatactccaactcttaattcaaccttgatattgagcttatgattagataacaaaaaaaggaacatgacaaatgttttcaagtgatttttaaagtaagttttgtttttgttttcctggaagtgctagatgattgttatttaaccaaatagttttttttttctttaactcttaggccagtcattctatatcatttctatttgtcagcagtgccagtaacattttagaaaaatgtagctttctggtctttatctgtagggattttaactaaaaaatgtggaaagaaactcaagaaaaattagatacaaagaagtgagaaggggatccaggaaggaattctgaaattctttagagactcaaagaagaatacaaaatttatcatgtttggctattaggggtcattgatttacttttgtgagaatagattcaatagaatatactggaacagaataaagactgtagtgttaaggagttattggaaagtgagacattggcaagaaatttatctggattttcatgaagtttggtaggacagtgaaggaaaatgtggagtactactaaagaatgtatttctttcttgtctatttttgagactggaggacatataagcatgcttatagctagaaaagcagaaatccatgaaatttgaaaataagaaaaaatagtctgaatgtagaaggatgattccagaaaaagcagacagagaagatcgaggtcatgcaattttctttgaaaagatggcggaatatttcacttgggacagaaggaatattattagatataaataaagacagtttttgttgaagatttgggagagcaaagtaagaaaaggtgaaaggagtctattatgggtaagtaaaattactgaggaataaaatctagggccttcctaacactgagaacaatcagaagatataaaacaccctcatgttctaaaaatgaggcccaataaaaatgaggcccaagctacatatgaatttcaaagagctttctgaaaactctgtgtgtttatgtggatatgcatattttgaccattaatccagaatctatctggagggtataaattatccaggcctttgagtctgagtggtgaagggattaggtaatccactaattgttttgcaaaattgagattacttttatttatttggatttgatacatgcctgtggatgttaaaagggaagtgctaaggctcgacatgtttacccagtgacagggcaatgagacacggcatcaaggggcacaaacttacataaaaacaaggcagtgagatggagctggtctcagataggacccaacagggcttccctccgggaacaaaactagtttagcagaaagagggtagaaatacactgtcaaatgggagctgaggggctggggtttaaatgaccctcagaagcatgacattgcaattgaatgtcctgggtacctccaaacaactaggaaagtatcttaataagggaacaagtcagtgttgaacatcgatcagccccagagagtaacaacacataattatagtcaagaaaagccatccattgccaactttctcttagtgccattgctgaaatcaccgtgtttgagctgctaagaagtgtcaagatgaaatcaggaggaaaaactcagagagtggccatagacctctaccacattctccatctgaagtttcttggtctgaagcagtactaacctggtaatgggattttaaatgaattttacattaagcttagacatttgatttttattccagactagatattttaattgattaactgagactgcttttagcagtaacacttttatatacaatggtgaatggaaaaattagggaacctgaaaggcataatgttgtgttcaaatatgattaatagacaagacaacaaaagggtgatttaaacagagtgtggatttatttttcctcctgtaataagatatacgtaggtaggcaactcaagagatttgcagaaatcccactctgttacttctgtgtctatctcactgggcaacctttggctgcaagggggataagaaatgtggttttagctaggccactgcttctctgaacaaaattgggcaaactctcaattacaatgtatatcccatcagttgatgtctatgttaagactttttcaggatttaatatgagttttatggaagatggtctagagaaaattcattttaaagaagcagaggagaggaaaggaaatattgttttctgttggcattttttatatggagccccacctttcaatgtaacagttatattcatatcaaatcagctttctctaatatggcttggcgcaatacgaagagtagaaaactgcaattacttttgcacaaacttaatagaatgaaaaagactgttgaatccatctaggattgaggattggcaaagtaaactttgtaaacatcaaggatatttgagaatagtcaatggtagttgaagtatttgaaaccaggaatcacgttagataggatctgataatggtcaagaaataagagttcaagtaagtagtagacatttttatgtggataaagtgtaagtttgtaaggaacagtggagaaacaagaagttgtggtaagggacagaaatttaagaagttaagtgttctgggtaaaaacaaggtagaggcatgagtcaatgagctggttacttagatggagaagagtgaaagttttcggagttttactagtaaggggcaaattaatcagtagcatttactgactgtctgctatggtccagatgctttgctaggcactttccatatatttctaacactatttctgttctgcaaagtacatatagttgttttcactgtgcacatgggagaatgaaagcctggagaagttcaataatttgcccaagcttacacagctggcaaagaattcaaacccagctgtgtatacagtaagttctcacttaacatcattgatgggtttttggaaactgtgactttaaatgacacgccatataacaaaccaattttcccactgactaattgatataagcaaatgtgaagtgtctatggcatattcttggtcacaaaaatatcactaagcttttacgtaaacaccaaaaacttctgttattaaacactgaaataaatgtgagctatacgtacatttaagaaagattaatatgaacaagtaagataattatttacctaattatcccagttcagagtgttgggtgaccggaacctctcccagaagcttagggtgcaagatgggaacctaccctggacaggacatcatcacatcactgagtgcactcatgcccatacccacacctacttgtcatggggcaattgagacatgccagtttacctaatgtacatatctttgggatgctggaggaagctggagtgcccagaggaaacctatccagacatggggagaacatgcaaactccacacagacagtgctctggccgggaattgattttcattttttctcatcagcgttataacaaaacaatatcgaacaaaatgacattattcgaggacctgctgtatctacaaaaatacttggtgttcccttgtgtgtcctgtcatttgtttaaaagcttacaacattaactcatctaatctttacagtacatagctgaaactaagaaagattaaatgacttcaccaaatcttacatagagtgagagatttggtctggaattcttgtgtttatgttatctaacttttaggtggctgcatcatgtttctcagctccatggcatctcaataatcttagccaaaatttatttgtctgtcatttgtccagttaaatcaaagcagtctgtccagttggcatgtacttattataactaaaaaagccatattaatgctctactgggctctcatagtaccattattttcaagtcttttaaagtcagcaacgtcatttattttgcttgccctacagcttgtaacacctacctagagtgtagtttagctagtttagctaccgaataaaattcagacataacctgaagaatatttttccagtgaatggttgcccagtggattgcctcctgatttttgaaatccaatctccacaggctagactgagctctcactaagatgtttttgtttcttgttttgctttttgctgatgcttataaggcacctacttacatttacatcttccaatctcaatgtttttaacaaaataacatgtgatttacattacagttagtagaacatcagaatcatgtggagatgccttgaaatgtagtgcaggtgccaactaaggagatgtgcatgttttctgctgacagcgaaaggccaagtagggcctacgacactgtatgttaacatcttattcattgtatgagcaggaagtgatgcttgtagccctttacaccttaatatatggtttataacatttgtccacgcaccttggcatttggtgagtgtctattttactgttttctttaggtggttaaaagctggttgtgaggggtttaggttgatataaaaacgctctattttcttccacttaataaataataggctatcagaattttcactcagaacatcaggtttttctgaagcagattactgcttaagtgggagatacctgtcctgcttgatatcatttgttaatgtggtaaatggaaagccccagatacaccatcacatttcctctcttacgttacacactggagcagcatctttatggatttttaagtctaaaataattataatggtaggaatttggggccaaacagaagtgatggtgaaacactaagtgctgtgtttacgacctcttgaattacactaaggagacagatccatatacctgtaactgtgctatactctctaccgcactcagcattttaattttcgtaacattttgttctgattaatgtattatttaaaggttagcagtgaagtttttttttttttaaaacaactccttccttccttcttctttttttttttttggagtttggctcttgttgcccaggctggagtgtaatggcgcgatcttggctcactgcaaactccacctcccgggttcaaaggattcccctgcctcagcctcccgagtagctgggattacaggcacccaccacaacacccagctaatttttgtatttttagtagagatgcgggtttcaccatgttagccaggctggtctcaaactcctgacctcaagtgatccgcccacctcagcctcccaaagtgcggggattacaggcgtgagccaccatgcccagccaaccacactttctgttttaaatctctcagtgctagagagtgcattttcctcccacattccatggagtagtgtcagcactaaatgagtatttgaacaaaggcacttttgaaaaaaatgtggtaatcaaatatacctttaagatagaaagcacaattaatggtagagggcacctaattatttaatggaaggttcagacaaggaaagggttggggcaacagtgataggctctgtcttctaaatgaaatctcttggaaatgagattctttgagttggctttaggatcagaaagcactatctaatgtaaaatttatgttctggtaatgcagcatgggggaaagggagtgttgggtttgtaattactttgagcaaaatgagaattagctcaagtggcttgcaaaactcacacaggcaaaaactacacaatttgtagagcctagtacaaaatgtaaatttgaggctcttgttaagaaattattagaatttcaaaatggcagcatcagagaatgaaaccaaacatggggtccttctgaatgtggagtcctcactgagtcagtcagcctcgtctgactgcacaggtctcacacccaccaaagctggctggtcctgcgcataggtcgttagtggtagagctagaaccagaacttgggattctcagctacttgtacagtgttctttctatgatgatagtcatcaaactttacttggggacttgagagtctgtgaaatccttgatgattgttgaaagataatcccaaagtgaggcaaaaaaagaaaaaaatccgtatgtcatttcacctcttttttttttttaacaacatagcaagctcgcctcaacagaaatgctctgatctgaatgtgctagttaatagtgttttgggtgaaagtaaatatagagaaacagtgctgatccaaggccaacctctttatttcacataatggaatctttaaagagaacttcatggtatcccataaattcaaagacaatctgatcaagtaatgtttggtaacattaaacaacatttagccatttatagagttggactaaaagtggtgttctgattcctaaatgttaactttgttttttaatctcttgatatttagttttcccttttccttgttaaccccttattatctccccacagaatgaaataaactctaaaccttcctctgtaaattcatttgctaacttttactgaatgacatgaaggtagaagcccgttgtgagatgcccaaacccatcctggcttttttatatacacaggtgttctttgcatctgttcttcataattgtttaaagcttctaaagtcaaaaactgcattcgcaagataagatttctatgattctttaaaaaatctcctgatacgatttatcattagaatgatgaaatgctctgtcactttaattaaagtatcatggatcataaatctttttaaattttatttttattatttttttgagacagggtatcattctgtcacctaggctggagtgcagtagcgctattatggctcactgcaaccttgacctcttgggctcaggcagtcttcctgccttggcctcttgagtagcgagacatatgctaccatgtctggctaattttaattttttttttttttttttttgtaaagccaggatcttccagttttgcctaggctggtctcaaactcttgacttcaggggatcctcccacttcagtctgccaaagtactggccttataggtgtgagccaccatgcccggcccaaaatcataaatcttgatggaatttgggaattttggaatttcagttttctggtcttttcatctcttgcagttgaatgtctaagccaccaaggcaagggagttggcagttcttttctcaaatatttttagtgattaagcttccacaattgtaaaaccccattattgttgcttagcttgtttttttttttttttttttttttttttttgagacggagtctcgctctgtcacccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccacttagcttgttttttaagaaatgattcctaacatctgtgtccttgtctaattgaaacatgttttcttttctctctcctgtgtacactaaaatttgattggcattctttttagaagaatatctcattttgtatgtatgtgcatggggggcgttggggatggtaggagctatcatcaattcctcacaacttagtgtttttggcgcataatgatggctttcagttgctgagccatctttattgccagacattgtgggaagtgctttatacacagtatcaaatttcatcttcagaataaccttatgaggaagatatgttattgtgtttgaagataagatacagtcttcttacagtctgtaatctgttacattttgaggcgaaagccatctcacttttttttgaggagggggtaagactctattttattttattattttatttctttttcgagacagaatcttgctctgtcacccaggctggagtgaaatggtgccatctcggcccactgcaacctccacctcccaggttcaagctattcttctgccttagcctcccgagtacctggggttacaagcgcgcaccaccatgccgggctaatttttgtatttttagtagagacggggtttcaccatgttggccaggctggtcttgaactcctgacctcgaatgttctgcctgcctcggcctcccaaagtgctggggttataggcgtgagccattgcgcccagcacccatctcactctcaagtgtcaggtagaggaagttttatacccaggtatgtctgacttatgtctgtgcttttcaacaatgtgcttttagctagagctaaaaggttcattaagtcatagatgactttaacttatataaaatctttatataagtttttggctttatatatatataaatggctttatataagccattaacttatataaaatctgtttactaattttatagtattcaattttgtgaatgtattatttatttagctatctcctactgatagtttattttttatgtgggtgatatgaatactgtttatagcacatctttacacatatatgagaaaacttttgattgctttattatacttaagtcatgtaagtgaaattgtagtgtctaacagcatatgggagtcaggtggtggctcactcctgtaatctcaacattttgggaggctgaggcaggaggattgcttgaggccaggaatttaagaccagcttgtgcaatatagcaagaccctgtctcaaaaaaaaaaaaaaaaaaaattagccaagtgtggtggcatgtacctgtagtctcagctcctcaggagactaggatgggaagatcactcgagcccagaagttcaaggctgtggtgagctatgatggtgccactgcactccagcctgggtgacaaagtgagaccctgtctccctcaaaaccacagatggtgcattatttattgtttgttttccttttaacaaaatagaaatctttaattcttccattaattccttctctcttttttgtttatttttaaataacagaatttctaatagacttaaatgacagcgaccaagttacatttgactcagtataataagttaaatatggttctgtaagtaggacttaattttaaatgatagatatatttttaattattataataatgtcaaaaactcatacttttctctgcagattagtgcctttgttgttggcaacataatcagttcagaattaacaggctggttggggcaaacatctgtcttccagatttatttaaaaaaaaaaaatcagcctcagagttgcagttactgattccagataccagctcatatgctctatcttgcatgtattatccagccacaggcagcatgccaacaggccgcagtgtggatgagtgctcctgctgttggcagtccttgtattctacgggagctgacgctgtcaaggcccagttaagagcaaaaaccaagttgtgtcttgacagctgagacattagttacaaaagactgtctactccttctctggttaatttattcatttagtctcaggactcattactccccaattacagctactcctataaatgttggtctattgtgaaccagtcacccctgattgtttacactgtcttttctgagaaattctaggtccgtcaacttaaaggtctaataataaataataatgactcattttctacaagagggtttagagagaatttattgccctatatcttactgcctgtgccactttttttctagcacaacaacataatgtggttcttaaacaaaaaaataactaaataaattatcaagtgttatatttatgtgctcagaacatttctttaaaatgtggattttcaaatagccatttttgcttgtcattgatagtaacaagtttgactcttgcagaaatgttcattttcattaagtgactgcacatatcaatttctacctctcaaatgggtattttttagtttagataaaaagatgaatataatgtataatttttgatgtctttgttaacaactgtattttgattcaaaaattgtatccattgaaatgaaattaatcctcatgatttctcagtagagagtaattatgtttttagtttaaatattaaaatgttctaaaaatatcaagtatcttatatgagaccttaaaatagaaggtcttaataacaattttttatgtgcttctgatatactagacactgtactaaggacttttttgtatttactcatttaatcctttcaacatacttctatacttggtattgatagtctcaattttatagagatattttgcccatgtatttgtatccagatccatttaattcccaagctttctggcagcatatctcctcactctgccttgcacttatcatgtgtcaggcactctgcctagtgttttacacagatttttccatttaattctcttttctctgacttctcctcttcctactctttctcttcttcttctccctcttcctctgtcccttcttcttcctctttctattgcctttcctatttgtcttctcattattattacatgatatgataaggccaagaagtatagaatgaaaaagttttaagtatattatctgaggtcatgtagttctaggttggcatttttgtttctaaatgagattatgtattactgttttattttacatcagatgtggtatagaaaagtgataatggtagcttattttaattgttacaatttatgtaaaaggagagaaggattgaaagagaagaaggcatggagagaacaaaggagaaggggtctagcctttttattctctagacttacttgcattaagtatttacataaaatgtgtggtgaatttggtaatggagatggagattgtaacatccatgagtttttgttaatctcactgtaattacttagttttttatgtgtgaaaaacaagaattttagagtatctgcaagccacatagtgtgctggggcttttatactcataagtgagtatattttaggagtgttttggggaaactctggtctagatattacagcatatgtagttgcataaagatcaaaattaattagaatagtttttatttctgaacttgagcttagataccatgcagacattcacttttttaattagcaatgagactagcaagctttcaaaaaaatcattctggtctgttggtatttcaagaagtgatttttgctagcttctaaagcataggttgtaggcaattgaaaagtgaagtatatcatttgaagttctaagcataaggcatgcttatttaaccaacttttaattacaactagtgagaaatggagggtaagtatatagttaaaatacaagacctcttacacaattaaaggagaaaggagagaggcatcatatgagagggcaaagtaaaccatggaggtcagctgagttgatctagtatagtacaaagagcttgggaaaactctcttcggattttcattcttcactaaatttacagatgtttaatgtattcaccgtcattctttttccccaaataactgtttattggagctttataattttgcaaatgaagctatcttttggagattgctctttctttaatttaaatgacgccaaatgtctgctagtcatctggcaaggaaaatcagggctgcttggtgttgctatgctgccatgatcaaatttctcttctaaatagtagtctccagtccttagttgacatttcacaccaattgccctgtcactgttggaggctaaatcagcatattaagaagcagcaagtggtacctaatgcctgtcctgaggaaagttactaggttttagtcaccgcaaagattctcagctgctcctccttaagtattttagacatgctcactgatttgaaacaacatttttcagctgcatagaaggcatactgaataaatactggaaggaggacagtttaaagacttaaaagcagtctctgtcaaggcaggccatacttttcctctcagccgtacacacacacgggaattatccctatgatctgcctgtgttttaaattgccacataagtaggcatccattacagaggaagctggcagtgtacatttttgttgtgtttgtgtgacagtagtaatttcctacttctcaatttagtgacagcattttaaaaagaaaataatgtatgcattttaagaagcagtgagccccaaaagacttctaggtactcttggtagcttatatataaatgcagaatcacatgtatggtatagttaatgtttactcattcggtaatattcaactaacattaaccagtgaaagactggggtctgcctaacatggctttgatgacatttgtacagccttttctgatttactttctagtgttaagagtgtattactgaatcagattgatatggtttggctgtgtccccgcccaaatctcaccctgaattgttataatctccatgtgtcaagggtgaggccaggtggaaataattgaatcatgggggcagtttccccaaaactgttcttgtggtagtgacagtctcacaagatctgatggttttataaatgggagttctcctgcacaatctctcttgcctgccaccatgtaaggcatgcctttgcttctcctgtgccttccaccatgattgtgaggcatccccagtcaggtggaactgtgagtccattaaacctcttttctttataaattacccagtcttggatatgtctttattaggagcatgagaacagactaatatacagatattttgatttatatgttagctactgattgaatagctttagttttcttttctttcagatagaacatcattctattatatttggttctcatcagagagggaaaaatcttataagcatgtcttattttaaggaaccggattgttctctttgtgagaatttgggagtggtgagagaaaggagaattagagttagaactggcaagggtaaaaatatttgatttttaaaaaaaattcagtcagagaagaaataattttattaatgtttataaaggcagtaagtaatgaaaggaaataatcgagttatcaaggacatacacccaagtacaaacaagcaatgctattcagtgagagacttcaggaacacttctgtcctgtcagttattagaacagtgttgaatactgttaaaacagttattttaaattcttatgtagttactatataaaataattaaaactaccttatttattatctgtgtcttttaggaattcttagtgattgtatttaaaatttataattataggttttaaaacataagcaaacttatcatttgtcaagtaaaatacatattagattttttatttttgaaggtttttttgttgaattttttggtgcctagaattcccatactttaaagcaaataatatttaaaaaaaaaacacctggtgacattgatctaaggaattaattttaatttctagccaaacccagtatttgcaaaatgtaagcagtgattaactaaaacttcttaagaaaaaagtatcaagttaaattttgattaattctactgttagcgggcattagttgatttacactgtgtgtagaattggttgtgtggtgaaatacaatactgtttgtcttatctattattcaggatttatttttctagaattctgatttcctccccttcttcatgttatcagtagaggatgacatttttaatttgcatgtagcaggttaatttttaaaaaccaccttgtcttttagtgttatcttacctgattttttttctggcatacctttctttttatttgcaacattttcaactttcttttagtgctgttcttttcaagcaatatgtagcttttaatttttgatgcaatatgaaaatttctgtctcttaatgagaaaattcaatccattgatgtttactttgatgactgaaaaacttgtttttatttattccaacttaccatttattgttttagaaaattgctgctgttgcttttttttcttattgtatttctttccatctttgtacatgatcatttgaaagttgtgctttttgaattcatcatggtttctattctttccttagtctttcaataaccctactgtttaaatatggtaccagctattttgcaaattaagatgcactgtatctctacactgatgctcctttctccctacttctcttgccctcctaaatccaattgatacaactttaagagacacgacacgttatttccttttttttgttgttgttgctgttgttgttgagactctgtcacccaggctggagtgcagtggcacaatctcggctcactgcaacttctgcttcccaggtttcaagcaattctcctgcctcagcctcccgagtagctgggagacagagtgagactctgtctcaaaaaaaaaaaaaaaaaaaagataatatgcttaacttttagagcaggagagatgaagtttttggtccctgtttctttaacactggaatatgatatgatatggggtggtaaaacacaggttgctgaagccactgttaacagcagtcatatctgctttgaattatcacattttcattggcataatgacggataagtttatctcaggcatttttgtatcatattaaaatatcattattactgctgctacagtgacagggtctttttttagtccggagagaagggctgctgttgaaaatcacaattaaaattggtaaatattttttatccaaatatgaacaatgtaaattaaataagattttattttattattttttaaatagaaaaggtggcatgcaaacgtttgagtgaaataattctctcaggagctgtaagattactaatagttagcacacctcactaatgttatactttcttgcaattcttcccacatattgttgatatttaaaacatttgtttgctgtgctgactataggaacaaataagaatactgtttttgccagaagtttcattatcctggtgtttggaagaatggaatgaaaacaatattctctggctctctcacattcgataatgaccaacacatacagctgactggaagaataaatgctctcagcattgtgaatacaagttgagttcctttagtgtctataaaaacttaatgaagacaaatataacttcattttttccttcaattttcaactgagctaagatggccagtatagcaaatacagaaaaaaattaaatcaagcaaaccaaagtatttacttatctaccctagcaacctttgatcctttgggattcagatataaaagaaacccaaacattattgcgattgaaaaagtaaatggcttaagcattatttattcatgtgattcttttagaaaggtatatattctcccagagaagcactggatatatgtaaaaatgtacaaaaagaatgtttactacagtagtttgcattaaaaaaagattgatctaaatcattgacatgatatgcaatatgattttattttttagtgctgattttggagtaatatattttaaattacaaaatatacatgttcaatgtaggaaatatgagaatgagaaatactcgaaatcctattacccataaataaccatgatttgtatttttggtgtatattgaaagaaccaagggaaagtttccactttgccctctaaaggtatgctgaaaaccgacaaaaggtacattgaaaggagaaaaggcatacacattttattaacatgcacacatgtgcagagaagtcatacagaatatgaaaactcaaagggccagttggttggtgcttttataccatgttgaggttatggaaggagtaggagcttggagcatggcaagactggctctaggagagaatggaaggcatgggacaaaggtggtctcattaggcagatgaaacttcactgataatatctctgagacagaatggatagcataacttgtggatgagttaatttctgagatctgcagataagtagggcctctgagaaagcctggttgtttacttcaccaatatagatttttctcaacagatgcaaatcttaatgaaaggcagctttttagggctattgttgtctgcaggccctctgaatagccgtctcaaaataggtcaaagaaatatatttgagggtgaaatctttttggtttcctttagtctcccacttgaaactttatcttcacaaagattcacatattaatcaaagattggtagctatggggaaatttgggttggagattgtgagatagattgacaaagaagaagaaaaaataggtagattggaaaacctagctcatatcctcttgaatcagtctgttagtcctgaggatagatcagttcaattaaacagttatttcttattctaggacgttgcattgcagatggactctcaaaccaggactgtacatacgatgcacttaaatggatcgttaataacaggcatttctatggaaacaagaaaaacaaaggctaatgtctggactcatctgtaaattagtacttttagaatttgaagcatcttcggtttaaatgggcacagtgggaatccacagtcttggattgtatttcaaatcaagagtttcaaggccaggcacagtggctcatgcctgtaatcctagtactttgggaggccgaagctggtggatcacttgagttaaggagttcgagaccagcctggccaacatggcaaaacactatctgtactaaaaatgcaaaaaatacaaaaaaaaaaaaattagctgggcatggtagtgcacacctgtaatcttagctactcgagaggctgaggtaggaggattgcttgaacccgggaggcagaggttgcagttagctgagatcgtgccactgcacattccagcctaggtgacagagtaagactcttgtctcaaaaaaaaaaaaaaaaaaaaaagtttcagttaactttctgagtctacttcaatagtcatgaagactgtttatatataagtggctatagtggtttctcccaaagtttatgacagattgtccagctccagtttgtagggctttaacaaaagcacaattttaatttctagtgatttttaagtcagaatggtggatgaaaaattggaaacagtagattggagaatcacaggggactaaaaatttaagattcagtccagattgcaggtaataataaaatctcaaaatcaaacaagaaaaatttcagtgagctggaaactagtaacgggtatgctatagtaagaccaatttatttataaaatacgttttagtcttattaaccttggcctgattatttgtttaaagtgcaacaaggataatgattagtcatataggccataagttgactttgctgtaactttttcatatgaaatttcatattagacttttgaaaatcacttaaggtttagagccaagccaaagactgtgtctataataccagtctgaattgagtaaatttctttcttctcaaggtccttaaaatatgttgaggttcttgggggcctgtcagaaagtgacataatttacttatcacaacaaggtcgggaattttttaagggaactgtgtaggcaaggtacctgggccagtctttttccaagtctgttggtgttataaagtcagtcccagtgcttcaaagcagactggtcacattttaaaatatgtctttctagtcaaagcctgggtaaaataaccagtgtcttcaattgtgtcctgttacaaaataaaacagattgttattgaacttacacaaataactatattgctataaaataagaatatttataaataacttccaaattctggagagagcagtagaaaggtaaatgtttaaattgtgctcacaaaagtttattctacccaattgttacaagctgtaagtaacttgaaagaaaaaagatttttttttgattgtggaaaagaactgtaaaaagtaaacagcatcaacaatgtttcagtcaaaaacagtgataaaaaattagttttgtcctccatcagttcagctaaatgtaattcttgttctgcttgatactaggttagcaattttatgagtctagttttttttttctttttttgtattggagttttagaaattcttacctagtgcatttgtatgatctaaaaagttgtcagaaatgtgtatttaagaatacttgtagtcttttccatgaacctccttgaagacataccattttaggatttgcaaaaagcttttatggacaaaaagcatcagaataagcaatttattatgacaacaagacttaaaatgaccatggttaaagatggaactaacaaggacttttgttattttctgtggcatacagaaatttaacacatcagatatttaggaatttcatcaaattttggacacatattaatttatacacatataactcaaagaagattaaacatcatttcttatttgacagtgtggtctatacaatttaataaatcaaataagccggattgtctctcttttggatgccttaggggtcctctgtaacatcccaaagctaatttgtggtcagaacacttaatttacaacttaaaattttattctgtgaagcctattaaacatgtcagaggtttaaaacactttatcaaaaataggatcacaggtcattgtgaaataatagtcattgatttagccaaagtgataattaaaagatttcaaaaacaaaaacctttactgtttgatagagaggggactcaaactttccaaatatttaaaagacctagtaaagacagcaggagtcacacagaatctgtttctctctcccttcccctttttttgaagttttcctaaaaggtaaacccaagtcttttattatttcttattaatagtatatgaaaatcttattcaaaagaaaaaaacaaattatagctttgcattaatatgtgtttttgatatgaaggctcaatttaacaaccatattaataaatttatttaactttatccatttaaccgcataaaatttgaaattctccttttccctcaactttctatgcccatttagttttgtctgcatcatttttcccttaattttaaagcaacctttaaattacctctaaactagacaaaattattttctcaacaaatacacatacatcctcataccttttataacttttcttaccaaaaaatatatctgcttttcttgtacacattgcatatagaattatttaatagatttaattatattaatttaaatattaactcttagtaaccttaatttctagtgaaaacctaggaagtaattttgaactgtttcatatcagtgtttgtagatgaaaaccatttcataatttgtaagaaagatatgttttcctagtttttaattgacagatctaaatatatttagcttttctataccatataaaaataagatgttaaagcatataaatttagagttatatttaataattaatgttatagtatttttaacttagaaatgatacagacatttttatgactattacttaatttcacataacaagccttaaagactttactgaaaagtattttgcaactatgacacaggtacccttgcgaatgtcttccccagttgccctgggttctgagtactcacatggcattcaggacaggtatgaagaacagggactatctgggtcctggatccatataccaggtttacaacccaggacagaggacagaggtgtgaacatggcagttggtgggccacgtgccatggacacacatgtgtttccaggtcttactatggccacttctccagactccagcatccagaggctcaaaaccaaagatagaagctcacataaagatatttacagggatttggaagaatccagcagccagcgtttacagctttagattacagagaaattaaacaagcataaaaaatattacagaggcagcagtttcatggccttaaaaattgtagctcagacaccttaaattacctggctaaccagtagacccaggcaaaaatgtctgaattatatttagtatagttctgaagactttccattttatcaacaattttttttttttgagacatagtttcactcttgtcacctaggctggagtgcaatggcatgatcttggctcactgcaacccccacctcccaggttcaagaaattctcctgcctcaacctcctgagttgctgggattacaggcatccaccaccatgctcagctaatttttatatttttagtagagacagggtttcgtcatgttggccaggtggatcttgaactcctgacctcaggtgatccacccgcctcggtctcccaaagtgctggtattacaggcatgagccactgcacctggcctttaccaacaattttaaaactagctttgtttaccaaagattatgttggttcacttagaaatatcacatatacataacagatatagacatataacataaagagacacagaatcaaatcttgcagctttcattgaaattctcatttgccaacttccaaatagcccttctccacccgatttagaccatcaatcttcagatcacctgtttcattgccctatgcaactgttagctaggcaaccttaaacttgcacttctaaagggatggccctaggtgaattaagagagaaaatttctgtctcaaagacagagaacttgtatgtaaacttcattatttgccaagacaaagaagggcataggtaaaggcccatttaagacacatagccaggaaaaataccttaaacaaaagtttgttatggaaatttttaagggaatgcctttcccatggtatgggtttccagtggttttggtgtagagagggagattcccttacaaatggagagttttcttataggtgtaaatcttttttacaagaagtttgaaaatgggcagcaaaatattggagagttgtatttggaagatccatttagttgaacaggtggctttttaagtttctgtttcttaaattaactagattaccgaattcagggtggagcccatgaatgaattagggctgaacctacttgtgactgttggggctctatgaggaagataggttacccaaaaaggagacaatggcaccttcgctgtgttttgaaggcatatcagcgttcctagaagtccctttttgatccctttatgtgacaaccgtaactctcatgtttcttttcagtacatttttatccattgattgacccaatggaagaaatatgggtttgaagggggaacaatcaatgattaaagggaactgggtagaagactgaaggtggcaaaggaggggaagaatcaaatggagcattgagtccaagaggagccagtgtggatacatctcaagcttcgcaaaaggccaatgaagttttagttttttctttaagcaaaaatcttgccaataagaaaggaagtcaacagagggactgaacatacaattaggatggcgttttagttcactgaaaaagattcctgtgggagaaacaggatccaaaagagaacagagaagtttaaaaaatatgtagtttgaatgtcagcttttaattaagctgatgaccatagagctcttgtaaaatcttttcaaatctttcaccatcaggtttttgctgggacaaactgccagtattccagcttttgaatattttttatccctctttgcatttaaacagaaggtatctaccaagtgactcagaatcaaaaccagtaagtctttaatgactaagcaaggatgcaagaggtatctcaaaagagatgcaaagaagcagtcctaacaagatcaagagccacccccaaagatggctagaagaagaaagggacatagatatgaacaggagagcaatagccctccttggaggggaaaatgatctataacaaatgggtaccccaaaatgtcaaaagttacaaaacttcaaactaattcttatataattctttataagaattataaatttataaattatataattattttaagaattataaatttataaattatatagttatttataagaattacataattcttgtcaggcatggtggctcgctcctgtaatcccaccactttgggaggcagaggcgggaggatcacttgaggtcaggagttcagaaccagcccggccaacatggtgaaactctgtctctactaaaaatacaaaaaaattagccaggtgtggtggcgcatacctgtaaattccagctacttgggaggccaaggcagaagtccttgaactcaggaggcagtggttgtagtgagtgagatggtgccattacactccagcctgggcaacagaacaagactctattcccacacctaaaaaaagaattatataattcttataaatgtttattttttctcctaagttaaggaatttacatccacatctctctgagtgtctaatgagattcaaaccttggctgcagctgtgggagcatagaaccctagccactaggccacaggctggagtgctttttttgcagatcccatggagaaaccaaagcaggctgttgagaacacaaaggattttaattttaatttaaatcagttgtctgcctttttgttgtttttgccaagagagattttaaggctattttttttttttttttgtattttttcgtagataccagtaagagagctggtgaagagaaacactcactaaaaggttttcttttaaatgtagccaattttatttattctattaatgactcaagctaataagccttttacttggaaagtcccagagataactttccaggtttagcacaccatggatataagtggcattttaaaaacgaagatgcaggcctcatgatcctccagaaaattcactcccagaaatagattaggatagcagaagtctctttttgccacaggttaaggatggtatttctgcatacgatgtctccagtctctcagaaatttgtgggaagctgccagtcactaacccattaatctgtgacaatggatagtccatgtgcaattggactttcccagatctaaccatgtagtaaaagttgagacagcaaaatctccttcttcttctttagaggatggaacttcttcttaagacacaatttcttcttgagacagcaaaatccccttcttcttaaagggatggaacttcttcttaagacatattcacctgagaggttggcaaattcagaacaaagagtgtgctgcttaaaatcttacttgtcttagggttctcacttctttcacgctggctaccagacatgaccccaaaatcatgccatctggatggctgagaccaaaaaatagtgattccatttgatgacaaggtagactctcagggacataaaacaagaccaaagggactttatgacaacacaaaaaacaaagacaaaggaaaacacatgactatttctgggaggaaaaggatcagacaatatgaatattccaaaatatataccagagtcgctgaacctaagactagtctgtataaatgcttttctctcattaatcttaaatttggaaaaggaaaaacagtaactgtcactatctgctcaattggattccacagatagacacctgggtatctgactagtaagaaatttttacctttctgtcagcctgacagattctgagttccctcgactgcagcttcaaaagagcttcaaaagagcttttggttacgttgctcatagcaccaaaagtgtagggaaaccttccctttgccctctatagatatgatgaaaatcaactgacgaaaagcaaattaataggagaaaatcatataaatttattatttgtgcacacatgtgcatgagcatcatagaaaatatgaaaactcaaggaataggccagatggttgttgtttttataccatcttgtgttataaaaagtatagggacttggagcatggcaagacaggttataggagagaaaggggcaaaggtagtcttgttatgtagatgaaacctcacaggtagcagctctgagaaataatggatggtaggctgtggttgagttaatttcctagatctgcaggtaaggtgtaggccccagaacaatcttgattgtttatttcactaataagattctttttaaacagagcaagtctccttgacaaaagacagctttcaggattatcgttaatttgtagaccctctgaatagccatatcaaaatatgtcaaagaagtatattttggagcgaaatatttttggttccctttattatcatcctattatttctatatatttactttaagaatcattgttatgccaaaatactttgtatgcctgtgaatgtgtgcatgagactcttacaaaatacagtgtcttaattcaaatgaatttcataagttattcttcacaattatcattttagagagaagttatctgaaattcagataaataaattacccaagattgcaacattaattagtggtagagttaggactatttgagactaatagcaattcttttttaaaaaattaacattaacattttttgagtcattacataatatgtgtacatacttacggtgtacacatgatattttgttacatgcatagaatgtgtaacgatcaagtcagggtatttagggtgtctgtcgcattgatattttccgtttctgtgttgggaactgatcaagtcctctcttctagctatttcgagatatacaatacattgttgttaactattgtcccctactgtgttatcaatcattagaactcattccttctctttcattgtgtgtttgtgcccattaaccaacctgtctttatgcccctctctatacacccctcccctaaaatattcctagcctctggttatctatcattatactttttacctccataaaataaacttttttagcatccacatgtgaatgagaacatgtgatatttgtctttctgcttctggcttatttcacttaacgtaatgatctccggttccattcatattgctgctaatgacaaaatttcattctttttttgtggcccaatagtattccattaagtctatatgctaccacattttctttatctattcatctgctgatggacacttagactgataactatctttgctattgtgttatagtgctgcaacatacttgggagtgcaggtatccttttaatacgctgattttctttttttttttttttggattaatatccactaatgggattattggataatatggtagttcaatttttagttttttgaggaagctccatactgttttctgtagtggctgtagtaatttacattactaccaaaagtatataagagttctcttttctctacattctcacagcatctattacattttgtccttttattaatagtccttctagctggaataagataataacgcattgtggttttgatttgcatttccctgatgattagcgatgttgaacttttttttaatatacctgttggccatttgtatgtctccttttgagaaatgtctattcatgtcctctgcccattttttaactgttgaattgtttgagttccttatatatccttgatattagtcccttgtcagattaatagtttgcaaatattttctccccttcaataggttgtctttttactctgttgttttctttgctgtgcagaagcttttgtttaatatagtcccatttgtctaattttgtttttgttgcctgtgtttttaaggtcctggccttagaattgttgcctagaccaatgtactgaagtgtctcccctatcttctcttgtagtaattttatagttttggatcttacatttacatctttaatccctctttagttgatttttgtatatggtgaaagataggggcccagtttcaacttagcgcttttgtaaaaaatcagttggctgtaaacaggtggatttattcctgagttctctgttctgttccattggtctatgtgtctatttttatagcaatgccatactattttggttactattgccttgtaatatattttgaagtcaggtactgatgcctccagtttcattcttttagttcaggattgctttggctacttgagttttttttttttttttagttacatacacagtttagaatttttttttctatttctgtgaaaaataacattggaattttgatagatattgcaatggatctgtacttgctttgagtaatatagttgtcttgataataattattttggtcttaaagaccaaatgttggccggatgtggtggctcacgcctgtaatcacagcactttgtatttttagtagaggccaaggtgggcagatcacaaggtcaggagatagagaccatcctggctaacatagtgaaatcccgtctctactaaaaatacaaaaacaaaattagctgggcatggtggcgggcgcctgtagtcccagctactcaggaggctgaggcgggagaatggcatgaacccaggaggcggagcttgcagtgagccgagatcgcaccactgcactccagcctgggcgacagagggagactctgtctcaaaaaacaaacaaacaaaaaaacagaaaaaacaaaccaaatgttgtgtcatttctccaacatatcatcatgcctcctatgttaactcttcttttgtgacatggtttttaacggttgtataaactatcttttagacattctaggatttacttaactattcccctttagtagacaattatatttagcttatatttgtctacatatataattattgttgggatgcatgacttgtacatagtcatttctgaaattcaggattattgcttgaataaattttaagaattagaaatcctgtaggctgggcacagtggctcacgcctgtatttccagcgcttagggaagctgaggcaggtggttcacatgaggtcggtcgggagttcgagaccagcctgaccaacatggaggaaccctatctctactaaaaatacaaaattacccgggtgtggtggtgcatgcctgtttcccagctactggggaggctgaggcaggagaatcccctgaacccgggaggcagaggtcgccagccatgaaccgagattgcaccattgcactccagcctgggcatcaagagcgaaactccgtctccaaaaaaaaaaaaaaagaattagaaatcatggagatgaggatttgtgtatttcaaggcgttttattacacatcatcaaattgggccgtgaaagtatggtctaatgtttggatgtacttgttctctcacactttgcctacattaggggttaccatttagaaatttatgtgtcaattacataaatggaaattttattaatacataaaacattttttatatgaaaaatcaccaaaaacccccaaaatctagaactctaataaggggtacagttatatgtagattttgttatttcaatagagtttataggttcatggaacattatttaggaaagaaaatttaaatatattctgtctataaaatataaaagcgtaggccaggcggtggctcatgcctataattccagcactttgggaggctgaggtgggtgaattacctgaggtcaggagttcgagaccagcctggccaacatggtgaaaccccatctctactaaaaaatacaaaaatttagccaggcatggtggcaggcacccgtaattccagctactcgggaggctgaggcaggagaatttcttgaacccagaaggcagaggttgcagtcagctgagattgcacaactgcactccagcctgggagagcctctgtctctctctctctatgtgtgtgtgtgtgtgtgtgtgtgtgtgtgtgtgtgtgtgtgtattatttaccaaaattaatacacaatttaatgcaaacatcccttatttatgtaagaaaatttatttaaaaaagaattcatatttgaaatacttgaaaattaggtatcaaattttctaccatctatgttggtgggaataaaaaggatcattatcaagctactcttaacaactcttttttcgttgtgtatggttagggcaacatttacattttgtactatgtatatatttatattttgattcatcaagtttataagagaaaaatgatcaccctaagacattgggttactctcttaagatagcaaacctggctgggcacggtggctcacgcttataatcccagcactttgggaggctgaggcaggcggatcacctgaggttggagttcaagaccagcctgaccaacatggagaaaccccgtctctactaaaaatacaaaattaaccgggtgtggtggcgcatgcctgtaatcccagctacttgggaggctgaggtaggagaattgcttgaacccaggaggcagagtttgcggtgagctgaggtcattcctttgcactccagcctgggcaacaagagtgaaactccatccctcccccgccatcaaaaagaaaaataaattaaaaaaagatagcaaacctttctttagtcattcacattcttaccatctcaacttttatgcaaattcaatgaaactgtaatatgttaattaaattgcaatgtctacatttggatgttatttatcaacctaacaaatcttcctttgtgaaatttaaatttggaagttatcaactgcttcattataatcactaacaccagtaatacagatcctagtttttccttatattaaagtattcagactgttttgaaaaatgagactatatcagtttcacgcatattttaattttagaaagtaaatactaaatctagattattatatttataatattttagttttacattatttatttttattatagaagacagatttgtggattagatttgaattctcagtattctgaattgctgtaacctcactattctaagtattctaatttaagaagccttcttcctttggttgactatcatttaataatgtccttaagttggaaaacatggttgacgtgtttaaactttaggagttagaaataattactgtgaaaacatggtctttcctgcatacttacggtagcaaatatagcaaattactgaggcttttcatatatattctgataacctttagttttatatgaattactcatggcttttacttttgttttatgtggacaacatggtttgtatattacatgatgaaagagcttttcaaattttcattcttttacgtataaaatattattcatttaaaatggtatctgtaatcctattaagggctatgagtccttctatgatctagtttgtcctttcctttctgatttaattcctctttacccattacaatgcttcagtccacaggccttctttatctttattgctgtctgagagtatttgcacattctgttccctttacttaaaaaaaaaattccctaacttcgtgctttatttactttttctttctttaccttaggtctcagtgtgaagatcaaaatagcctgcttgacgatgttgtttaaatcagacacccacccctattgttattctgaatgagagacacctacctgtattatcttcagagcaatgatcacagatcggtcatgattcaagtttttgtttgtttcattgtctcctaactggtaaaatccatacgcgcccatttcagttcatatttatcttcatacctgttgggcctaacatcgttcctgatatatagtgggtgttctataaatatttactgaatgaataagttggttaatgagtaaaatataggttttttccctttataagctctctaatattttctgattttctataatcctattaatttagggctgtagaaatcaattatgtttatctgattgctactcatataataaaactgaagtttgaaagatgtgatagtgaagtgaagacactttgaaattatgcattctactctcatctaacttttttttttttttttgagatagagtcttgctctgttgcctaggctggagtgcagtgacatgatctcagctcagtgtaacctccgcctcccaggttcaagtgatcttgtgcctcagcttccccagtagctgggactacaggtgcctaccaccacgcctggctaatttttgtatttttagtagagatggggtttcaccatgttggccaggctggtctcgaactcctgacctcaagtgatctgcccactcctgcctcccaaagtgctgggattacagacgtgagccaccgcacccagccattctcatctaactttttaagtaaaactatcttcactgttctttctgagaaaatgctgattgcaaaatacccaaaacaataatgagaaagtaaaagtttccactttaacctactttctccctaaaaccccccaaaacaaacaaaaaaacctactgagaataatttggtatatgatcaactttcattttgtacatagtatgtctttaatgttaacaacatgtttgtatgataagcagagaatttttttttcccaattaaccaggtgagtaaaaaatgacttggtatttactattatttttactttttttttttttttttgacagagtctcgctcttttcacccaggctgggtgcaatggcgtgatctcagctcactgcagcctctgcctccccggttcaaaggattctcctgcctcagtctcccgagtagctgggattacatgcacccgccaccacgcccggccaatttgtgtacttttagtagagacggggtttcaccatattggccaggctggtcttgaactcctgaccgcaggtgatccgcccacctcggcctcccaaagtgctgagattataggcgtgagccactgtgcccggcctatttttacttattaattgaattatatgtacataaacttgcctcattagacatttggagctgggtgtggtagcatgcgcctatagcccctgctactcagaacactcaagcctaggagttagaggctgaagtgtgcctgtgaaaagccattgctttccagcatgggcaacatagtgagacccttgtctcttaaaaaaaaaaaaaagacatttgcactctttttaaaaataaatttcatagtatgattgaactataaatatgaaatttaaagtaaagaaaggaaacttattcataagttctggtcaccaattttaagtaaagagagtaaatacggtcattcagatgttaacaatattatagaaaagaatggaaaacctggattatgtttctgaaatatataagcttagaagaagaaagaagacagtggaatctcagatgacttcataatgccactctgtaatgttatcttttagtggcagttacagttctagtccttttatatatactagtacactcagaaatcaaagaactgggtggtagatgggaatgtctgcattgccctgggattccctattggtggaaaacatttacatgatactagtttttagagtcattatttgctactggagcattttaaaaattcatactaaatattactcaataattaccagtcggtgtgtataattctacaatagctgcaaacatttttgtattgaagagtttttgaataacattttctagttagtgatgtatttcataataattttgttttaatatatttaatgaggaaaggtttttaaaaaattattaaaatttcaattttactctacttgattctaattaaaaccaccccttggcaataaattctgcttcttatatatccgtattacaagaaaataattgaggaaacttaaggttgtttcttgtttatgaaggtggatgaatacataattatttattaagattgcttattagtcgttttgttttatagtaaaatctttattaacagcctccagcatctgaaatataatacattcccaagaaaatgtgctatatagaataagctggccaatgttataaggcacagatattggtaaagactacaactacattaaaaaggctaaaggtgatctcaggaataaaaacgtagccattgtatcctagaattctgtttgttcatttgtttaatagaaaccctttttattctataattacaatgacttttttacaaaaattttttttgaaaaggaatgttgactctgctagtctacaaattgtatacattctttctattgtgcaacagcattggtaatattagaagaaacacacttctaattatgtgaagttaccaactgaaaacaagtgatagcttgccattcaacatctccccccacaaaggaagtattaacaggtgtggtatcttagtattagctgccaggagacattcatgttacagatcaatgatcaagattgttgttatactattaaatagggtaatacattttaatgtgagttttttctatttgtttattttttgagacagggtctctgttgctcaggctggagtgcagtggcacgaccttgctcactgcagcctcagcctcctgggctcaagggattcattcacctgcctcagccacctgattagctggggctatagatgtgtgccaccatacctggctaatttttttttttttttttttttttttggtagacacagagcctcactatgtttccctggctggtctccaactcctggacttaagcgatcttcccacctccgcctcccataatgctgagattacaggcataagccaccactccccgccaatatgagtttttactaatgagaaataatagtatcctaaaccctgacatttaaaatgatttttgcagatacataggcagtcaccaactacatgcataaatccttttaattttaaatctcatagattcttatttattgaatgccaactatttgctaggctcctacaggttggagtggcaaaaattcatattcacctacatatgcaattaatcagaatactatataacaaatgaaatcataaagaatgtccacatacagtggtaatacataggagagaatgattaactctgttttgttgtgggatggcatggggtcagggaatgctatagctgcattttaaatcagtccatactgaagtgaataggagtttaacagatagctttaaaaggagacatacaacttgtttaaataaaatgtgcaattaagcatcttgggtctaaatttctctaaaatccttcctgctattctaagaggtttataattaggtgtctttctgctaattaattgcagtagcataaagcttcacttacttgtaacagctatagtgcccaaggctgcaaaattttagcagacacattgagctaactgattcggatgtcagaaatgctctgagatgttaatcccattttaaaggggtcacttacagaaatagtttttcctcttcagaatctacatgtttttttttttaattattattatactttaagttttagggtacgtgtgcacaatgtgcaggttagttatatatgtatacatgtgccatgctggtgtgctgcacccattaactcgtcattcagcattaggtatatctcctaatgctatccctccccccttcccccaccccgcaacagtccccagagtgtgatgttccccttcctgtgtccatgtgttctcattgttcaattcccatctatgagtgagaacatgaggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgttcatgtgtctttatagcagcatgatttatagtcctttgggtatcagaatctacatgttaacccagtatcctcacacttttttttttgtcacaaactggccctgtgttatagcaatagtgactcatttatgtttatacactataaatcactaatctcaacactttgggaggctgagtaatctcaacactttgggaggctgagatgggaggatcgcttgagttcaggagttcgagactagcctaggcaacatggtgaaaccccatctcttaaaagaaaaaaaaaagaaagaaagaaattagcgaggtatagtgcatagtggtgtacagctgtaatctcagccactggggaggctgaggcaggaggatcgctggagcctggggggtcaaggctgcaatgagcagtgattgcgccactgtactccagcttgggcgacagagtgagaccctgtctcaaaaaaaaaaaaatacaagctactttcttagacattttcaagtatacaataaattgttattaattatactcaccttgtgtctcttgaacttattccacctgtctaactgaaattttataccttttgatcaatatctccccactttgttattttactgtaacaagaaaccttttacattaacatttatgtttaaggttctttttcctttatagaatatttgaggaaatgggcaaaatgaagtattggaaatataggtgttctccaaaaacgatgtctcaagtttcacttcctttcctgaaagatttttgtgtaattaataattagatggcaagtcttttgtctttctcctttttaacttagcaagtaaaatattgacaaattataactatgagccctgtattagttttctgcagttgatatgtcttggactgatttaactttctttttttgtcatgtagatgtttataaattggatatatcatgtaaaagtaaaacattttaacaacataaaatgtagctagaaaaatataaattaaaaaattaactcaaatttattagtgtaattcctttacaaagtttcagaatgataagattgatacttactttgtaggctgttggtttaaattttcttctacatggttgggcttcagatatataactgctttaaatttggtttatcatctgttttgttgcagggattcctctgtaattattttagcttactagatttcatgactcatgacatatttttaacattgggagatacttaatgacatgacttatcattaaccattagtcaatctgctttttattgtgaaatttatttttccttccagaataaaatagctcatctcagagtacaaaaagtcatatttctgttgcagcagaaaacttaattatagtaaaaataaatgatgagtcatgtcaccatatagaaattgcaagtgtgaataaccgaattcctagattcaagagaagacctgtgataaaggagcctaatatcaagttaaaatttccatcctgcatctatgttacagctgacttctacatcaaaccaaaaatatttgaattttatgtaataaaggccaagttatttttactgtcaattttaagtacttttagtagtaagaaataagaatatcttgactagatatttagccatattaaaatatagccgaacaatttatgttatgttaaaatagttcagtttactagagttttgattaagcatggtggcttgaacaagcatatctatctttattttctttcaaatgccccattggaataaaataaaggaaaaatgaagacttaaatctgtgaggataaagatgataaaagagaagatagtgtcagataagaaatgctaacaaaattgtagagccagaagagagatcattgtcttctaagagcagaaagagcaaaaagctaagggcctctactgggataatatataataaatatttctattgggaaataatcacatttgcacctcatatctctggaagattttagaaacaggagccacaagctgcctttaaaaagctgggtgcaaaatatagctgaaaacataaagattcattgaaagtgtttaaaataaattatattcccagatccttcccatactgaactcagccctgggttgaacccaagaagctctggactcagagatagctggagctaagagatgtatgaggcatcattctaaaacaggaaactattttagaattaaataaagcctcttctttgaggtgtgagatacccaggctcctcccttcttgaatcctagaattagaaaggagtttgtaaacgtaatttctgcagctattggcacaagagaggagctcttcagagactgacattttgggatttgcaaacaaaatggccaggtcaccaactgaacaccctacttacctgttagcaaacctgcccatgcagaatgggctttcaactagcttttcaaagtcttactcttaaatatggataaacaaagattatgtatgattgaagaaagctttgaacttaatgagaaagtcaaaatgacaaacaggataaaaagaaaaaaaagacaaaagcaaaaaacagaggcaaccgagacaatgcaggaaactgaagaaaacttcaaaaaatgatattatacatccttagataagagatctttcatgtgtaaaacaagatttagagtgctatataaaagggccattgagataatttataaaaattcataactgcaacattaagtagaagtgaagaaaggtaaagttaaggagactctcctagaaaaaaggcaaagaaataaaaaatagaagataaagtcataggaaattagatcagtctatgaagtataaaataaggtttccgaaaagaaagaaaaaaaatcaaggggaagaaattattttttaatgtgtatgtgtgtgtgtgtatatatttgtatatactcacatatacatatatgcatacatatgtatttgtgattctcatatatttgtatatagtaagaatgcttactcatatattcatataaaatttgtttatttaaattatatatacccatgtataatttcccataactaatggacttggaagccagattgaaagacatcataagtaggaagtgaaataatgaacaggacgttgacaagaggtttgggaacactgaagaaattatattacagctccagagagaaagataaatgacagtacattggaataatagtcaaaaaggcagtagactttttaataacactggaagctaaagacaatgtgaaataccttaaaaattctgagaaatgataatttccaaactagaattgtatatccaaattatcaatcaagtgtaaggtaaagcacgtaaattttcaaaaaattgttttcccgatgcaccttttctcaggaagctactggaggaagtgctccaacaaaacaaggaaacaaacagtaaaaggaatacatggattgttttaaagaaacaggaaattggaaacgaagaagcaaggcaattactgatgtcagcagagcagcaagcaaggagtttaatcccatcaaataggtgcagggtgatggagttatccaggacttatgtctccaaggaaaacatgaggcagatggattgctgaatatatttgatcctgttgaagtgactaagttttcctttagagaacctgagaatgtataactccagggaaatcaataagttgtaaaataaaggaagtgtcacagcacactacattgcttagctatgagtaatattttcattatcataattatgtcagcactgaattatagaactacctaaaagttgccactagctaaactggaaaaattgaggaagagaaaaatgtgtgtgtgtgtgtgtgcgtgcatgtgtgtatgtatgtgtgtgtttgtagtggggaagggaaagtaacaaaagaaaaataaatatgtattttgataaaacaattttgtggatattatctaaattttaaaaatgtatagcagttttagagtgttatatttaaaaatggaagtatataacaaaaatagctaacataactgaaaacatttagctctgggctgggtgcagtggctcacgcctgtaatctcagcactttgggaggttgaggcagaaggatcaccagagcccaggaatttgagaccagcctgggcaacatagtgagaccacgtctctacaaaaagaaaaaaaagaaaaaaaaatatatatatatgcacacacacacacagatagatataaaaatatagattttatatatattttttatatattatatatctagtatatataaatataaatatatatatttatatatatctatatatcacatatatagatctatctatatatagatctatctatatataaaaatatatataatatatttttatatattatatatttaatatatataataaaaatatatattttatatattatatatctagatattatatatctagtgtagatgtagatagatatagatgtataaagatatctatatatctaaatagatgtataaagatatctatatatctaaatagatgtatatttatatattatatatactatatataaaggaattatatatacactatattctatatagtatatatattatatatagaatattttaaatatataatatagaattttatagatatagaattctatatcgatatagaattataattctatatcgatatagaattatatgtacaagtggcctgcacttgtagtcccagatagtaggggatggggtttggaggatgaggtgggaggatccattaagcccaggagtttgaggctgcagtgaggtgtgattgcaccactgtactccatcttgggcaacagagccagaccctgtctcaaaggaaaaaaaaaaaaagaaaagaaagtagaaaatgactggctctagaagtgaattaagagtggggaaggtggcaggctttttaaaaataatgctttcactgggtgcgggggctcacgtctgaaatcccagcactttgggaggccgaggtgagtggatcacctgaggtcgggagtttgagaccagcctgaccaacatggagaaaccccatctctactaaaaatacaaaattagcccggcatggtggtgcatgcctgtaatcccagctgctcgggaggctgaggcatgagcatcgcttaaacctaggaggcagaggttgtggtgagccgagatcatgccattgcaccccagctggggcaacaagagcgaaattccctctcaaaaaaaaaaattcatggctttttttttttttttaatatacgacctgtagtactcattgacttttaaattgaacacctatattatatggggaaaatatgatttaataaaaaataaaatgaaactgtttgcaattggaaatgaatttatattgctttcttatataaaacaatgtgttaccctcaaagattagcttggactcttacgtcttgtctaggtttgtgcttatttcaacttagtatattactgctgaaagatgtacctgtttccttgtcgaattgtctatttttgccataacctaaaattaaaataacaacaattaatgcctcctcctcctttacctcctcatgaaaatatttgaggcatccttttgatttttcctgtattatgcttgcctctgtcctttagtcttcctttcgcttagttcagaacttcattaactcttacctggaatatattaggttggtgcaaacataactgtggtttttgctattaaaagtaatggcaaaaaccgcaattacttttgcaccaacctaataggaacaacttctgaaatgatatttcaacttctagcctctctctgctttaatttgttctaaagagccttcagcttgaacttcagaaatcacaacagtaatgtaggttctactttaagtgaacaacagcaacaaaaaagttaagggtaagatgaggcagtcttttcagtggaaaatacttgtcttggggacagtatgtcatgtccctatacctggtgccattgataaggttattcattcaacaatatttactgatcactggcatatgccaagcactctgccaactactagggatataaacattagaaagacaagttcctcccttttcagtcacgtttaaaaaggccgtaaatattagagttttctcaaagatgagtgaggtttcagagccaagtatttgttgatagagattcaagataaatgaactgtgtttgagctctgttaggttaaatggtgttttttccctctatgccttaagtcagtgagagtcatatttaattttttaatgaaagacctttatcataccttgaagttagaaattaattatgtagttggttaaattatttggaatggttaatgcctttttactgtgttcaattctagtcccatttttacctacctttttattctaggcctctgcaaacttacgtccacaaacaatttcagttgtcaaatgaataattcatcttgttcattgtattgcgaattggcatatctgagagcagatacaatggtgtgtgtttgtacaagaagccttttgttcttttgcaaaagaaaaaaatgtgaggtgtcaaaagatgtttgtactaaattatgtatatgttggatacttgattcttaaagtcatgctggggggtatatttaaatgtggaggtatatgactaggtcttattgtacttttttgcatttgataaattcaaatattttgactttcaattcaccataaacaaatagcattcattttctgttttataaaggacaaatagataactactttatttggatcccatccagatttataactgtgtggaactaaatatttgcactatgtggtcatggtgactttctgataggtagtggctgttgcagactagatacatgactgtgatttattatttaactatgggctgcgttcattacagcagggagcctcgcttcctgtagctcctttgagatctatgactgtcataacactttgcacagtggcatggacatcattctcagttgcaggtttcctctgaactcctccaaaaggcttgattttcacaacctcaatggaacacacagagaattcatgcctaaacttattgactctgatatccagcatgctcataggagcataaaaccataggcagctgttcttttgggtcccagttgtcaggtgggaaattacgaagagcttcatgctgttctaaataattaaaattaatactagaagaaaacctgctcaattagcatcagattccttacagatatggaatattaaatcagtgtcttcagagacaagtatgccttgtgagatacaaatattttagcaggaataatttttagtctgcctggatgactcaacagaatgtatcaattcaataactctttgttaaaagaagctaagcattcaaatgtgtgtgtgtgtgtgtgtgtgtgtgtgtgtgtgtgtatagaagcaaaataatacatcttttaatgtgagtgctccttctatagtcccttcagttaccttaactgccccaaacaatcttctcttcctgtaattttattaaaattattcataatataacttttagaggacaagggtaggataaaagggagtcacaaataataacatcttttaagaaatactgaaaaacaaaacaagttttaatactggaatggatgctaagaagagaattgcaggaaagtttactctatggcacttgaagacctttatataaaaaacttggggccgggcgcggtggctcacgcctgtaatcccagcactttgggaggccgaggcgggcagatcacgaggtcaggagatcgagtccatcccggctaacacagtgaaaccccatctctactaaaaatacaaaaaaaaaaaaaaaattagccgggcatggtggtgggctcctgtagtgccagctactcgggaggctgaggcaggagaatggtgtaaacccgggaggcggagcttgcagatcgcaccactgcactccagcctgggcgacagagcgagactctgtctcaaaaaaaaacaaaaaaaagtaaggagataaacaagccctattcttagcccttgtaactctcagagctttatacttttatgtttgttgttagatggctgataatttgttctctcattattttaattgtctgcatcatttttaaaagggttgtcagagagagcttgccaaagtacatgacatttaaatcattaaggaatcatactatggtatcccagatctgaaagtagaaagtgcatcataatgctatcatttgagaatttgggtcacctctcctgggagctctgaatttgatattcatttcctttctcagctgcattttcttcactaaaaaacagtgcagtgaagcatataggacagatgttgtgtatgagaaagaaaatggaaaacaaacacaactgtgcattggggtgcatgtgggaggagatataatagaattcaatgtggttatttctccagaacatcccagccaaggataacatccatccttgaggccagtgaccttattgctaaaactgcctgcctaaatataatttaagttactaagaaatttgtttttggaaataaacaagggactctagtgtattaaaaaaaaaaagaaagaaaagaagaagccaaaagtctaagctagatttaccacatgctaatatatttgtatgtcagggactgtgcaattagacttgaagttacttactggaattctacaggaaaaggaaaaataatacattggcgctaattgtcattacccttggttggagacatatatgattaaaaagaatgtgaagacagtgataattaataataaatgaactataaattagatcagctgatgattgagaagagaagaaattactctttaaatctgtgcgtgcttgttaaatggtgcaggatgcaaagagcacctgcctgcctttttcatgccctggacctgctgtgcttttgaaacctatagataagttaaatgtgttccaagcagcccatggagtctatttcatctttgtaaatggggggaaaaatctccacacacttaaataggcatggggacaaagtaacttggctaaagaagcaaaaaccaattggtgattaaaaaaaagaaaataaaacatttttctttttgctttctttctttttttgtgtgagaataaactaaagctttttaagaccagatgaggtattgagacatgatctaatctgccttctcccaccaggctttgctacgtcaataatcagtgtctgcctcagaatatgaaagtagggaaacttaggacaatgaaccaagctagaaacaggacttcagaaaatcactttggaaagattgtacaactttgtattttgcttagattataaaaagctataagatacttgtatatctgtttttgcctggataaaccttgtgtccatttcaatgagttttaaaattattttgagtaggtagttttggggtgtgtgtgtgttttagtaaatatgtgagaatcagagtttcctgcgagtgattataaatctgtttctttttcagcaagaaaaatagcgagtatgagggtaagagagcagaggacaagcaccaacagggacagtgataagacaggaaaaacagacttcccagagaaagggtgtttctcaatcgcttgggaccctttcttccaaaacaactttatgttgctgtctaggtgattaaagcccctagatagcaagtaatatctataaaagctactggcagacacacaaatgttaaataagcagatatgggagagaaggaaaaaaaggagaaaaagtacgaaacagtggtgtattacaagggggcgtggcagagcagagacagagaggaagaagagacaagggaaaaggagaacaacaaatattgccattggatagcccaagaaaatgctttcagttcctcaggagtaattcactggaatccatctgtggctttttaatcattgatctacaaataatagaatgattcattcatgtgcatacccccaactgtattttatcagctgtgccagtgttgcgtactttaacgtaagacatcaccaagtaggaaagagtcttcataacctgtgtttttcatagagggtcccatggcctccagtatcaagtttttaaatatgtcattgtcaaaataattagggtaaccatatgttccagtttaccaggaaaagtcctgtcccatgcgttcatatatgctactcacatttactcttcaaagggttcaattttaaaatgttacatatagtccactaatcatagtggatccagccaatgtgctgcaacccaaagctaccataatatatggatagtactgccctgacacctccttatcaccccctgctcagcatttactttttttataacagttacgtacttcatttaagagctgaagaatttcagagttacttatatgttataagtaaataagggaataactatttcaagagtacgtactgcatatcatgacacttttcagtctgggaaaggtaccttggctaggactgcaggattgcacagggttgggctgtgtagggggttcaaaggatttggggcctgattgaggaaagatatgaccatgagaggcattaccacaaaacaggttttattgggcagcccttgaacaggaatgcaagagcgaggaagtctctcacagcatgaagccatctggaagcttatggccatgaccaccatcgagaagaggaggagggcaaggggagctcctgggaagaggggaatcagagaggaggcttacatgtctatgtgcagtgattaagcagcactgggggtggttgtggatcaaagagctctgcatggcagcagggccttgggattttcatcgccccgggcttatttgatctattgctagtagatgtgggtggagttttaaggaatacacaaaggaggcagtctcctgtgtggctaaaaatctgtttgttggggctatttaaaaaaaaaatggatgcgtaaaaatttgagttttgttaagttctgaagggctggacctctcagggtcttatgtacattacaaagacaacccaagccacatatatactattcctatggcctgaatgttgatgtttctccacaactcctatattggaacttaaccctcaaggtgatggtattatgaggtgaggcctctcacaggtaataaggtcatgagggctctgctctcctggatgccattagcgctgtacagaagggcttgaaggagagagtttaccttccttgctcttcagctcctcctgccatgtgaggactcagtaactaggtgccatctttgaagcagagagcaagccctcatcagacactgaatgtactggtgccttggtcttgaacttgccagccttcagaactgagaaataaatttctttgtttataaatgactcagtctagggtattttgttacagcagcctgaatggactaagacaactgtattaaccctcacaacaagagggaaaatagtaaatacctgggcaaactccagtggttttttaatgtatcagttaaacctctaagccagtttctacattaacctgcatggtctcgcccttggagatacaagatacgtgatgctcatatttatttcagtttgcttttatcttttatttttaaatttgtgtagatttacctttttctttatagtttttttcctttttcttttttttctttttttttttggagaaggctcttatgttgcccaggctggagtacagtggttatcatagcacagtagagcctccacctcctgcctcaagtgatcttcctgcctcagcctctctagtatctgggactacaggtgcacaccactacacccagttctttgtagtttctatatttgaagttttgcttaaacagaccatctctaacttgagctgtttccttttcttttaatttatgctttcattgttttctgatttatttcccctcatgtttaacctcttaatctatatgaatgggcttacatgctgcaaggtgggcatctttttatttttctttccaaatagttaagtgatcattctagaatcatgttctcatttatttaaaaaattatatatctgctaatttgtttctagatgttcagctctgtttcattagtttttgcattattgtactagttacatgcattaatgctatttttcccttatgcaatttaatgtcccaaagtccatgtgtgaccttatgttactaaaaaaaatagagattctttatggtgattgttagtatataagaatcttcctcctatcatcttcttccaagaccatatcatttttactcctaagtccttagaacttgctctccattttcacagataccgttcacttaaaattctccattaatgttttaatctccatatgaaattgcttgttaggaactctatcaacatttatgctatttgattatatgttttaatacttgaataaatatctatgcttttttgtaaattttaaagttctataaaatcataagctatttagatgctggatccttcctggcttatcttttcactgttcacctgcccagccttgcatataataagcattgagttgtcttcttctaatgttagaaggaaactttgtggaagacagctttgtaaatgtctcataaaacaacaatttgagaaaactcaggttgaattctggaacacagaatggaaaagataggtacactattttctgaaatgaaatttttttaacttcaatttttttttttaatagccgcagttagattggtattcttcagggaaggtctaatatggtcaaaatacaattgtagtagcagatttcttataatacattgtaaggagcgtgggaaacaaaatctgtctctcgattcagatgtttaaatgaaggttctattataaagttaaaaatatttgaaaaattctgaatgcatagtcaccattgccatggcattaccagttttatttaatttgattcttatattaggcgaattgcagcgtttaaatttgtaatgtattgtaggaatgtgcatggtgtacctgaggtgccccttcccacaccctccctgccacacgcacataaaataaatttgaactaaaggaaaacaaatcagaaatatcctcaaagatgtcttcttacttaggaatcaattttattgttttggatatttttatagataaccctctgtgattcccccccccacattttacaattttatttacacaacactttgtttaataaaatggaattatgaaaacatcattttatttgttggcagtatatgaactagttataaatataagaaaataggataattacttaggttaagtatactgggaaatcagacacgccctccttctgctaagagtttttctcacaaatcctgctaaccttcctgcccacagctcttacctgtctcaaaggggtcaacccatggatcaggatgcatcagttacaactttcacatagatttttctccctggaacttgttgggagcatactgggtattttcaattccgatattccccaacttccctagatcactcggtggatccgaacataactgcaataacagattagatttatttttattttattttatattttagagacagaatctggttctgtcccccaggctggagtgcagtggtgcaatctctgcttactgcaacctccgcctcctgggttcaagggattctcctacctcagcctccgaagtagctgggactacaggcgggggtcaccacatccagctaactttttgtatttttagtagagaaggagtttcaccatgttgacaaggttggtcttgaacttctgacctcaagtgttccacccacctcggcctcccaaagtgctgggattacaggcatgagccactgtgcctggccaacagattagatttagctttggcacatggagtttttttctttcttttttctttttttctttgctttgttttcttgatatttacaatattatgaaagattttcaaaattgctatcatgaaaaacatcctaagttattgcaggatgtatgacattacatttataaagggaattgtcaattttagaatggaatcagagagttttaaatataatattttaaatttataaatcattttagctattaaatgaaagttcataatgacacgtacatttgatatttatattcattcttacatttaacattgatacaaattctataaaaatagcatctttatcatatcccgctatatgcttacagtgttttgaactattttttaatagaaatatttgtgcagataaaatgaaaggcaaggcataactctgaattttataaatattatagaggacagaatttttttggcataatgttgctttttaatctatgtgaaactccatataattgagaatattcactttctaaggaatgacagttagttggtaagaatttgggtgaaaaaattatatgtccacattgtcttgtgtagtggacattgtggctgtctcttgaacagtgagtccacccctctcctttgtgtagcatccatctggtttggatgacactgaccagttactgacatgggactgcgtctctcgacacaatgacttgttcttataaaaacccaagattccgttggttaacacatggtcttctgttgtctagaaaaactggttcaagagcagtcttatcaatgcaaagctcaagtctcttcagtagtggtgtgaggaagaaaaatctctcttttccactggccccaaaccagagtctcctgagaacaagaggagcctttaaattatggaggacttgattagttgatgctgatgtggaggtggtcagtcaactaacactgaatcacactttacatctggacttccttgttctccagtttagtaaattccttaatgatcagaccaatttgagttggattttcagttacttgcagctaaaggaaacccaaatgatatacctgctgctgtggaaatacactaaaatggattccaaatcaggagcctaaatttgtgtcttggttcttcatttacttgcagtttgacctcagacaaataaataatttccaggcaggcactggtgcacgtgtctgtagtcccagctacacaggaggctgaggtgggaggatcactggagcccaagagttcaaggctgcagtgagctatgatcataccagtgcattccagcctgggcatcaaagcaaaactctgtctctaaaaaataaaattaaattaaaataattaataagtaaggtttctatgtaaaaggggtagatgagattacataaaaagcttctaacgctaaaattctagaatctgtgatcctaaattggtttctaaatttaaaaaatgtaaatttcatgtaatggtgaagatcattagcttcttccagagctggactacagcttgggagtaggaagacaggcctgtgtgctcttcaggatatattaagatggcacacatcaaagtgtcatttgggaagatattagcataaacaaaaaatgccacagaactgttttattaattacttgagcctcgtgttttgtccttatgagctcttttgtcctggaattctgaaaattataatttgtcagtacttttgtcactcaaattttcctctctgtcatatgtaatatatatgtacatgtacatgagcatgcacacatactatttttatatgttaaatgtcttgaaatggaaactagccaaatctaacaataaaatatcatacaagtaacatgtattttcacttatgattcaaaataaaatacattgttcatttgaaaattaatatatttttagtccttctttttgattcacaagatttactttaaataaatcaataccaggtttttaaaaagtgttttgtttgtgtaatcactgtgcctttttttcttgtcacttaaaagagaagacatagaaaatagcatgcaattatatcatttttgtattgttacagatatttaggtccaattagttttgatcacttaagctgtgaacagagagaccagattgtgtgaaaattacctggaccaagtttagtcttgtggtaagacacaatctaattacattttaggttaaaaaaataactctaaagctacagagtacaaataataagcggtatatatacttattatgattttattcagggagacctaattttttcaaatcttaacaacagatcagttattaaaaggaactattaaaggagcagtaggttatgggaaccctgcagtctaaggagagagcaattatgaaaagttaggttagaagaagagactggatattatttaaggaatctgtttagttttagtcctatacagatttatcttcattgagatgaatataaacttggggaagaggtctttgtcactgagatttagaagtattaatagtcgatgatgaagaaatgccctagagaaaacattattagccagtcattttggattataacaactacagactggttgataatcagattctatagatggcctcttaatttgcagtatgtgtctttccctaaaatttgaattgccaactgttcagaagtgggctataccacttgtaataacttcagataaataaataaatacatacataaataaataaattccagttattaatggaaatggatgcattgcagcctgaaatagaggaggggcagaaagaaccctctatccacatacttttgcagaacatattcatttcagtttattgcccctctgaacctattagtcataatggaattaccttaacaagaaaattctattctttctccaaatactgaccatgtagttggcctgcaaaatacagtgaaatttttatggaagagaaaaccttggcactgacttttctgcatagcttccttggatgaaatgctgggatgggtggctgagggaaggttggaagctttaagggagccagaagctgaaagagaagtcacatggttttgcttaggttcctagaagcctttgaaattactgagaaccaattcatgtgttctgttgacatttcaacaggagtgtctgtgctgaacgagtagacccttacatgtgcttgcattttaagtcttacccctctgtatctgctttgatgccattaaggtttaatttaaattttggatcctctattcgaataaaactaatagaactaaaaatgtggggattcaattacaatcttgtaggttattattaatttctgtttgaattgttgtatttcttactccaaagaaataaaagggttcatgagttttataacagacttggtaaccatttttggaacttatcatctccactcaagattggaagtttctttttgtcaggaagatatgtaattttttttttttttttttttttttaagacagagtctcactctgtctctcaggctggagtgcagtggtatgatcttggctgactgcaacctctgcctcctgggctcaagcgattctcctgcctcagcctcctgagtagctgagatccagctaatttttgtatttttattagttatggggttttgccatgttggccaggctggtctccaactcccgacctcaggtgatctgcctgccttggcctcccaaagtgctgggattacaggcatgagccactgcgcccagccaggaagatgtgtaattttgtttgttgatataagtatattaggtaatcagtgatgtttcaaataaataaattgccttccatcttttgaataaattgtattaacataagaagttgatagatacagacaatctcctatttttatatgggaatcataccaaaagttgaataaatgaaggttaacatacatgttaaaggagagaggagccttgttgtcagagagctaaaaattattttttaaaaattcagttataggctgggtgtggtgactcacacctgtactcctagcactttgggaggctaaggtggctggatcacttgaggtcaggagttcgaggaccaacctggctaacatggtgaaaccctctctgtactaaaaatacaaaaattagcccggtgtggtggcatgtgcctgtggtcccagctacttgggaggctaaggcaggagaattgcttgaacccaggaggtggaggttgctgtgagccgagatcacaccactgcactccagcctgagcgacagggcgagactccatctcaaaaaaaaaaaaataaaagtaaaaaattaaaaaatcaaatatgcatttttttatgacaatcttcaattatatgttctcaacatatttttgtgtatgtgtgtgtgtatcctcacacaaccggttgaggttgaagatagactggtttcttttaggtctatcattgtcacaaccctactaaggcaatcacattcatggttttattccaagtaccagcaattttacttttccagtctatagccattgttgtataatataaaaaaagggggttgggcgcagtggctcatgcctgtaatcccaatgctttgggagactgaggtgggcagatcacaaggtcaggagttcgagaccagtctggtcaatatggtgaaaccccatctctactgaaaattcaaaaattatctgggcgtggtggtgggcacctgtagtcccagctactcgggggctgaggcaggaaaatcacttgaatttgggaggtggaggttgcaatgagccgagattgtgccactgcactacagcctgggcgacacagcgagacttcatccccctccaaaagaaaaggcaaaacgcaattaaatattcaaataagagttagactgacactgctacacagataaatgtgaaaagtctgtccaacaaaaccattgtgttttagctgctagcgttttgaacgatctctaaatggccaaacataaagtgatgttaaaaaaagagaaatggaggctgggcagggtggctcccacctgtattcccagcactttgggaggctgaggcaggcagatcataaggtcaagagatcgagaccatcctggccaacatggtgaaccctatctctactaaaaatacaaaaattagctggttatggtggtggttgcctgtagtccaagctacttgggaggctgaggcaggagaatcgcttgaacacaggaggcagaggttgcagtgagccgagattgcaccactgcactaaagcctggcgacagaatgagactctgtctaaaaaaaaaaaaaagaaaaagaaaaagaaaaagggagagatggatgtcaatgtatccatcaaagtacccactactggaaagctgtcccagtaagtgtttgtggtttcaaataatagagtgacaagctgacttaaatggcagacatatttattgaaagaatatattggctaattcacagaattaagaactaaacttaaaatcacattaagagccagactggggaggacactcttgccaccatccctgaacagaaacatagtttacattgctacctggagctactatttctgcccctaaaacaaactggctattgctgccctgatgttgctgccacggccagggtgggtctgtcactatccttgcttctctacgtcattagtttaggattaaaaatccaaggcaggtccatctgattggctaaatgaaactgtttggccaagtcccaggtgcgaaggaagtagggaaaacaagcttttgatttctctacttggatgtgaacattgactttcaacatagtttatatcttgggaaattccccaaatatagaaagatgttttaatgtacaacaacaaataaataaaactgtgacaagtgtccactataaagtttatctaattgcaattaaatacttcttgatgctgtctccaaacactcttctgcagaaacctgatggctctaatcagccaaagtaagtagattcaactcagttaaagaatatgataggaaaagtacctgcctaccggtttgcctgtcaagaaatgataatagttaagtaattaacttatttggtgtagatgtaaactagatggtgagagtgaagaccctggaatgatatgtccgttatggtggaatattttaaataaacggcagttcagaagtccattttgatctgccctattcactctttaagagactattatgtttcatgagaaaatcattaactatattgtctgtcaaagagcaaatgtaatatctaaaaacaattatttagtgcttactgtgtgcatgccgttgcagtgttgcttataagataaatgttttgatatctgagcgctgctactctttgccttcctgtgcgtattgcctttaatcagcttggcaggatgaagtgttgcttgtggaaagtaattacaggttttcagtggaaatgacagtgtaaagccagatagatggtgtttgtcatgctggagagtatactaaaagcatacacaaactctgggctctctgcagaaagaccccttccagagataatgatagatctgcttttgggactgatagaatcagcgagcaatctgatagggggtttcacattcaccttgggtgaacagctgtggtatctattcaagaagatcagagaagttaaaaagaaagtgttaaataatgggcaaacactgctgggcacatgctctgagatggatctgaattttaaaaaggagttataaacaggggagtggtattgaaattctgattacttgagagaacagttcaaatgtggtattgtttccagttcttttttagggaactacatgacagaggcaaggatcttgctgtaggttctaagtaaattttgatcttttatcactaataaatttaagtgataaatttatgctgtgatttaattggcatcaccggatagctggctgcttgatggaaaaagctgtgcattgtaaagcagtctatatatttcatatcaaatttgcttagtgcttgcatatgagattggttcatgagcaaataattttcactcagtatacttttgttgctacatgctttaggtcatactgtgtgaccttgcagataataaaatttggcttgttttattttattcctttaagttatgtcatttttatgatgcatggaacaaaatatattggccattattcattcattcattcattcattcattcattcataaatacctgtattgaacacatatttatctattgggtgcttaatgtatgtcaggcactgatttaggagctagaaccaacaaaaaagaattgcctcccctcatagagtttgtaatctagtgttcttttgagtgtggaagtgtattgtattcatatgagcccctgtacattattcaatatagatatggtgctccccacattgctttcccctttttgcacttaaataagaataatctaacagtgattgactcagtgaacgagaaagcagtactgattagaaatgtaggaagaaaaattagagtgtgcggtgtctataacccaagagtgaagacagtgtaaagaatatgtgatggtcagcaacttaaatgaagcattcactctaggactcacttattaagaaaacgtttcatgaatttttgctatttctaggaactagggatacagtagtaaccaagacaggcaagtttccagatggtaattttatgtttacaaattaaagtaaatatgcaataaagaaaataatagactttttatagtataaaagtactgagaagattggaaatctgggaaacatagtttttaatgtattgccaaggcaggctgctttgaatttggtggtcaaaagatactctcagtgactggagaggaagatacagtcgtgagaggagccatgagaagatgtgaaaatgccattctaggaaaaggaggggttagtgcgcaggctctgtgacagagggagctgtttgagttccaagatcaggagggtcactgtggttggagcttaatgagcaagtgcgagagtatataaggagagttcagaggggtagccaggggtcaaatgacatatggtcttctagaacagcagtcacagtgtgttacaatgactgggattattttcttcagtagaaaaattacattctcattgttaagaaactgataatatgggtaagtgcaaagtagaaaatgaagcatattcttaattctacacccaggtataaatattattaacatcgagaagcttttattttcattcttctttctattcttacataatcacgtgcacctgtatgcaggcgcaaatacatctgcacacttatgcatgcatacgcacacaacttttattaaattggaattatacccttcatttgcaattaatatattcagaatgttttcctatttcatcaaatataaaaatgaaataaaataatccaggcatggtagggtgctcctgtggtcaaagctacttgggtagctgaagcaggaggatcacttgaggccaggagttcaaggcctcagtgtgctatgatcacatctgtgaatagctacagcccaggcaacatagcaagatcctgtttctaaaaataataataaaatagaaaatattatattatagagaagatatacaataatacataataaataatatataaaatagaatcataatggcaacatcgtatgtatatgccagtacctatgactaatttagaagaactccagtttttaataccacaaatatcaatcctgtaaacatttttatatagaaatagatgtacaaatttcttatttccttagcataaattctcaaagttgagctatatcaaaaggtatattattattatttaaaaactatgaatagagcttgccagattatccatctggaattgtttagcagtttatgatagtgtgtttctatctcctcttcaatattggatattattttttaggcaacgaagttggtagataacaaatggcatctcacttttattttatttatttaactttattttgtgattttatttagaacataatatcaaagttgtttattagttagtagtattagttctttattggtacgtttccttattgctacatataatgaattacctcaaaataaagtggcttaaaataacaaatatttctgatctcatagtttccatgggtcaggaaattaggagtggcttacctgaatgagtctttctcaggctttcttaggtggtgcttctctgatggcttacctggtgctgcaagatctactttttaaattttcactgtgcacattttttttgaaatgaagaaaacaatgttatttataatagcaacaaacggaaacattcagaaataagtttaccaaaagaagtactaggatattacgctgatttttgaattttcttagtagtacctttattcttttgttttcagaagatccacttctaaggtggtttgtatacatggctattggcaggagacctcagttccttgccacttgggcttctttccacaacacctaaccatggtagctaacttccccaacagtgagcaattcaagaaagtacaaggagggattcacattaccttttacaacctagtttcttacgttgcgtgctatcctttctactttatgctatttgtgagaagtgagttgctgtatccagccgaccacttgaaggaagatgtatcaaatttgtagacatatgtttaagccactacagtaattttttccagcttctcactggcatattagagggtgttgaacacatgactacaactattattactattggatgactgatgccgccactggactacctatagtacaaaagttcctcaataaaggctattttatatttttgtcatatattccaatactcttgctgtcagaattcttcctttctaaaagctggaatactacaatttagattctatttatgttttatagaatatctgtcttttagagattatattgagagaaaaaaatctgtcagaagttttctctcataaattactcattttgggtttctgcttaattgagctttgacttctgtaaatttatttttccttttttttagtaatgtttagattgctagtccattatctactgtctaggattataaatattgtttattttgaaaaagttgaaatagattcaggaagaagaaagtgattattagagttttccattgtaattagctgctttcctggtctagccatttatccatcatctattgtctatgattataaatattatttattttgaaaaagttgaaatcgattcaggaaagaggaaaatgattattagagttttccattgtaattagctgctttgctggtctagccatttaccttactcttgatgcctgtttatctccttggctctaattaataactgtgcatctaaagcttattttttctcaacttccaaatagaaataataaaacaacgtactatttttcacacacaaaagggagaatatatttattcaaaaatatggcatgatgatatgctttgttaatggtggtggtattgatgatagtctgagaaccacaatcaataaattagaaattagcaagcatgtgtgaaatttgacaagtgataatgggttcatttgtggatggtagaaaatgaatacaattataattaaaaatgttctattttaatgaaataactatatatttagatgataaaggaaataaaatttgataaagaatcaagagaatttattcatttactgcatgtaggggagaaataagagtaaaaatgaatgactcaggtcttcagattgaatgactgtgtacatcatggtatttggactagaggggatctagtttctagagaaagtggtacttttcttttctacatgatgaatttgaggtgatggtagactctattgctgtagctgtcgaacagcaaatggaattagaagattgacacttctgagagagaggatggtagtggatatgtactttcatttaggtgacaattgacatgaaaaaagccagagcagaggcctgaatctggggttaaaacactgtatttatagagtggaagaatgaaatagagccagagtctcatgggaattatgacactcatttgtcatctgatgcagcacaggaatgagtttggataaagaagtagtttgtagttaaataaggaatacagttcaagaaagatgattatggagaaaatacagttagcttgaaatgggacataagagtagttagacaaaggacataatgaaataagttaaacaatgagtgaaatccaaagaagtggttaataggagtttggtaatgacgactttgaaagagtctgtgtagaaatttactagaatgaccacaacttaaaaaacaagaattaaaatttggatagaagagaggagctagcatatggagaaactggaacttaaatacattagatgtgtggatatccatttcacagaaaccactttggaaaattctttggcagtacctaccctacaatccagcaatttctaggatatttccaacagaaatgaatacatgtctcccaacagatacacatttttattcacaatagtccttaactggaaacaacccaaatgtcctttaacgaaagattggataaataaaccgaggtgtatacatacacagaaaactgcacagcaataaaaagaacaaaatatttctgtacgtagcaacaattatatatctcacaacaatagtgatgagccaaagagcccagatggagaagactacgtgttatatgattcaatatatatgaagtaaaggggtaagtaaattagccaaaactaatttatagtaatagaagtcatgacaatagctaccttttgggtttggggaatagccaatgactcaagagcatgaagatgtttggataaatactaaaaaagcaaaaaacaaaaacaaagattaacagtgcatgtcagagatagctgaggagagaacagctgaagaatttagttagatagaaagccaagttatgggcctataaagctggaattcaagatatggaaaccagaagggcagaacaatgatgcagaactgtataacaaaataaggcattggagtctttcttgtattctctttgtatcttagatgcctcagcctccaatgctgcttgctgttacaacatagaaaaacattggagtgattttagagatgatttttttgtgaatatgtcagtaaagtttgtgttgactgttggtaacattgttcatctactgaagcactctaataataagaaaagtgaattggagcttgaaaaaattgctgtgacattggaagaagagagaatgtaaatgaaggggttaattcttgtctgccactttcttcctggtgttgctgatgcctcaatcattcactcagaaaatgtttactaagtacctcttatgttttggacattaagctgggtacaaaggatgtagagttgaaggacagtgtctgccttaaggacctcacagtgcagtggggaaaattgtcaaataaacaagtaattcttgtagatgcacaagtaccatggaagcatatagatgataaagcatatcaattttaaactcatctatattctctgactccttaggtaaagagaatattctagagaatttcgggtggtacacaatgcaaagttatgaagcaggaagaaaatggtgagacatgaggctggaaaagtaggtagaggacagtaatgaagggtcttgtatagcatctgcccttggagtcctttacacttaagagtgggcacatctggatttgaattctatggcttgtctgtaaaatgtatgaaaaaaggagaataagattggtatttttgtaaatttacattggcagctgtaaggggtgtatgagtcagaggggttcaaaatcagatgcaggaagctaccaaggagactattaaagaaattcaggatggtgaagacagcttaaagggaaacagttctgcaaatagaggcgatgggagatataggaaagagggactatgtgtaggtcttgttgcgtcgctgaaggtgagcattgatagaaaagaagacatctaggtttcaggtttgcataaccaagaaagagtatacaagagaggcatcaactttctttttaaaactgtttgcatttcctatcaatttttctatgccatttcatcatctgctcctgttctggccagaaccactgtcttttcaatttcctgttgccagcctctcttgtacatcgggagctctggattaaagcttcccagccaccctttgcttccttatctttttcctgtcttatgctatttagcaggctttttggatttactgtcttggaaaggcttcttgtcattgtattctattcaacattcttaattgtgtcttttttttttttttggtctcaggtatctctcaaattctttccattctcactttctctagagcccaatatagctttttatgcaagacagcttgctccacatagcccaaataatttctcaacatttttcccaaccatggtccacacatccccaataattaactcttctgttttgatatttctggttttggttgaataagaagaagcgaagagaagaaaaaaaaggactgcgtgtaattagagggagagtgagtgacttggttgcccccagtaaatttttgtaattaaataaacgttaaacagtatgtttcaggttctctccgtaatacctttgctggctgttttatttatttttgtgaaagaacctttaaaggttatatcatatctgtgatatattatgctcagttaagtatttgctgagtatttaatattgaaacattatcttagacatttaccgtgaaacttcctttaaaaaagacaaattttaactttgatgcaattattgcactgtgttctttgaacaattttaatctttctaaactccacttaatatttcgcaaatacttttgtgtaaaaggataaaaacaactttatgccaaacgtagatttttcttctgcctatgtaaaatatttaagtaacttaatttaccaaaagtagcaaaataattgttaattctttatttatttttgttccctaaataggcagcttgtagagtctgtaggtttttttgttttgttttgtttttgagatggagtctcactctgtcactcaggctggagtgcaatggtgcgatcttggctcactgcaagctgtgcctcctgggttcacaccattctcctgcctcaggctcccgagtagctgagactacaggcacccgccaccacgcccggctaatttctttttgtatttttagtagagacggggtttcaccgtgttagccaggatggtcttgatctcctgacctcgtgatccgcccacctcggcctcccaaagtgctgggattacaggagtgaaccaccacacccagccgagtttgtaggtttaagggctttcaaaagctttcgtttcttcaattcagtaagataatcatgtttgctgttgtaaatgaggaaaagtatgaggtgacagttataaaaagaaggattctatttagaaccctattagaacttccaggctaatgggagaaatagatgagtactcaataatggtatacagtaataccatattatacaattaggtactataattgaaagtcttcagatgaatcgttagcaaacaaattattctgagctgttttcctgatttgaatttcttttcatttggttctggggcataactaattgtgacacttatgaactgtaaggttgtatttatatcagaaagtcagacctacagatcaataagcaaaagattagcaatctgaagaaaaatgggcaaaatgtaagtaaagggattttatacacgcacactcacacaaatgcacatataaaaagtgcttatcctttaaatcaaaaccatagtatagcctttttcacaaatgtatttttcactgaaaaataaatgctatttttataaagagtcattttaggattgtgatatttgtcttgaatctatttgaatctaaattgatttgccagttttaagaaggctatattctgtacacattcattgaaaacttctaggcaagtgcttgaagaatgatataattttaagatagattaatctttgagacttttgcatagagtccaatagattttttgatggataaaaatttttcagaagtagtttgtcctgtgattgaaatggatatgacaagcaaatcaaatactttttagattcggctttctttaaggtagtacagttcttcttacaatttagctggacataggaaaaggtcaaacacatttttgttaagaattagttgaggctgggtgcagtggctcacccctgtaatcccagcactttgagaggcagaggtgggcggatcacctgaggtcaggagttcaagaccagcctggccaaaattgtgaaacctcatctctgctaaaaatacaaaaactagccaggcgtggtgataggtacctgtaatcctgcctactcgggaggctgaggcaggagaatagcttgaaaccgggaggcggaggttgcagtgagccgagatcacaccattgcactccagcctgagtgacaagagcaaaaatccatctcaaaaaaaaagagttgaaaacctttcttgccagtagacttctgttaggaagcactgacctactgcatttagggtttcataaaatacttcttatgagttgatttccatactgctatatttctacatgtaaatttacaaccattttcatgaaattttctgctaaactaactcactagtacttagagaagcatattcttatcttaattggttgaaacataaatagattagaacagcagtgacctacaaagtagcctgtccacttgataacaaatagcaccctgcacttgtcaatcttaaatcaaaacctagatttcacatagacaaagaagacacacctaattattgtctaaaagccagacagtttctctttcatcttccaaattggtttattgaataaaaatgcttttgtggcttttttcaaggtaactgaatggctcctgtaagactgtcttgatataattttataagaaatggtacattataaagatgcatatacacaaataaatttgccatcttgtagatcaaatagacagtttaatgagctagaatgtgtttccatctaactgttttatcatcatacagacggagttggagcaataagttgccaaaaatataggttctttattgagattagaccaataaaataagttaccaaaaatatagattctaagagattctttattgcctctcagttctccaaattaaaccctggataaggggggaggaaaataaagagggcaatgattgaaaagtcaaaattttagggtataggcaaacagaaaatgggctgcaaataatggcaagtggttgaagaatgatataattttaagatgaattcatcttcgagacagctaaataatacttctgtataaagtccgatagattttccaaatctttcacaggggtttgctgtaaaaggtagttattcagaaataaaaaggaactcagagcagattaaatcaacttctggaaatatatctgtgagtcctccaaataaaccaaaaggacctattgtaaatgggatgtggggatttcttgaatgaaatccaaatgtgttctttgttaaataaatagaaggacaaaaattatactgacaccaaaaaaaaaaaaaaaaaaaaagaaaggaaaaattgttaatatgcatagattagatttggccccagagatcttacatcaaatatgactgggtttgcttgctttaggaaaattgtaaggtaatatttagaagaaaattatacagtgagattcagcatttcaatctgagaaatagtgctttggttctaatgagcagatgctcaactgtggattgagagacctgatgcaattaaaagatgtttttaggtgggaagagatcattcagccatgtatcgcctgtcagatctaccttggccagctttctgtgtgacagatgcagttcgattttcctaaatctattcagccagccattcatttggcagcagttcctccaacaataacttacaagacctgggtttggacgaagacttatgtgttcttttttaatataacagaaacctgatgtgtcattgcagtgatatgaacatgcctgatattatgatgaaccccagtgactttttaggagacagaacagagtctgaaatgggaaacaatggggagatatctgattaggggactctattataatctaggtatatattttcatctgtaagtgtgtatttgtaaatatgatagatatagagaaagtaaataatcataaatggtgtatcctagatgacactaatattatttttaaaaatcgcaaatgaggaagcaggtgcatcttgagtaggaaagtgcagctgtgagacacaaagtcatttactgtaggcacaatttgattcaactgatatgctttccctggcccattcttttccttttctttcttcatttctcttcaggtcagaggctggcagcataattaaaatttgaattatttatgaagagccattaaagtgggtggcttgcagattagtcagagacagcagagctgacactaagctgcttttcttttactctctcacaataaacaataccttcactatatgccttgaaaataagcatatgaagtttaagcttttaaaagaaaaatatataaaacattgtgaccatttacatttacaagcaaacataagtgagtatctatagtcatcataatgtacaaaaacagatcttttgtgtgtagatatatacataaaaagtgactttctgccaataattcattaatattgaataggactataattaccaaggggaacaatcttttgtagatatataaagataagactagaaatagaaatatacacacatgggtatcattaagtgtgcattttctatttagacagggacattgaaacagttcagaaacatctgtcaccagcatgatgtgttgagaagcaaaggaaatggaaatgggtgtctgttttctcaaaagcattagaatctgtaaacataaacatcctttttaaagatctgccaatttagaatgagtttatgggcttaatgcaatttttaaaaacggtgacggcctacataatcatgttaaactagaatattttccaaattttcagaggaaaaaaaaaacccatattatgtgtttatttatagccttatctcagtcttggaggaaaaaacatattgtagcatgtttcattttgcagagattggggtaatcttctctctaatttgtttgccatacccatgtagattttattcatatcatttagaggaaaatcaaacatacctttgcttttgctgcctttttcttcctcaccatgaaaaatggccaataatgatggataataattcagatggtaccaaaacaaaacgaaacaaaacaaaagtatatctatacctttattttcattttaatgtctcttttaagttatctctaagtggaatatgttactagtctgttggaataatcacttttatttcattttttaaaaagtcattcatttataatttcagagttagttctgtggatagggttataggggcagaggtatgtcatatctttcctcactcatcaccagggttatagcccacacttctacaacaagacaggttaataagagaaaagcataacaaatttattcaataaaggttttagccaggtgtggtggctcattcctgtaatcccagctctttgggatgctgaggcaggcagatcacttgaggtcaggagttcgagaccagccgggccattatggtgaaaccccatctctactaaaaatacaaaaaaatcagccaggcttggtggtgcgcacctgtaatcccagctacttgggaggctgaggctggagaactgcttgaacctgagaggcagaggttgcagtgagctgagattacaccactgtaccccatccagcctgggtgacagagccagactctgtctcaaaaaaaaaaaaaaaaaaaagtggtgttatgtgacataggagccttcataaatgaagcctcaaagacccaggaaacttgtctatttttatgcttaggttcaatgaagaatgggacagccatgaagaaatacgattggacaaaaaggcatgatctaatggtgagagaccaaggtgggaactcagcaaggcccatttgctcagattctccttggcctgtttgtgtagcattccttactcctgggtatggagcaggaccccttttgaatgaaggtgttcaaagggagaagggaggaaggagagagtgtgactcttacaggtttcatgattgctctgggagagaaaaattttagcttcaataactgccttggggaagaggaattctggtttttatggcttgtttcatgagagaaatatgagtaggagacaggaggatgggtgaaggtcagaaaaacatggtactgagaccttcccaatttccattagttcaaaatactcagcatgccaaggcatcatactttggggtatcattttctgagtcctgactgggtcaatctcatgtatttttttaaaaggaaaaatacaaaagtgaatttttttttagttggcggcaatgctctagaaataacaccattcatgtttaatttttcaagtgtaggctaaagctttctctgtttatctggagccagtgaccaaagcacttttctcagcatggtgctatacatatgtaaaaggataacatatctgtttttcttttagtgtttgattgatggatggatggatggattgatttttgagacagagtctcactctgttgcccaggctggagtgcagtggcaccatctcggctcaccgcaagctccacgtcctgggttcacgccattctcctgcctcagcctcccgagtagctgggactacaggtgcctgccaccacgcctggctaatttgttgtatttttagtagagacggggtttcaccgtgttagccaggatggtctcgatctcctgacctcgtgatctgcccgcctcggcctcccaaagtgctgggattacaggcgtgagccaccacacccagccttgtgttttattttttatatgaaacttccagaggttgcatataagtcagtgagccttacatgataaaataataataaaaaataatagcaacaacaacaatagttaacattcactaattcctggtatttgtcagtatggaaacatcacatgctttgtagtcttcaggagaaaggacaggcttgtcagctcccacattaacatttgaacttagtgttacatccaaagaagtcattcaggaaagaaagatgaacccattttaacacggaatgccaaagtaattgaaagtaaagtagcagtaggataccaggctttaccaacactgaaaaaaaaaattccaaattttttcacttagaatgaaaattttttatccatttcagatttccatttcaccctatatgttggttataatctttgcgatacgattgcttatcctagattagaaatgcataagtagaatactacccttatatctaggtgaagtgactgcctttatgatgtggtattaggaatccttaaaaagacaacacgccttctcgttaatacttatctcattgaatggtacctgaaagcagactttactaaggaaagcttactaaaatggaaataccatggcaaagggctacatgttagattcacctctgagcaaaaaagagtaggatgggaagtttggagataagatcttacagtcatgtgaacgtgctacttaggagaggaaaggctataacacaatgcagggtttgccaaagtgtcttctatagcatccaggttctgggagacactataaaaagtggtccaggccgggtgcggcggcccatgcctataatcccagcactgtgggaggccgaggcgggcagatcacttgaggtcgggagttcaagaccagcctggccaacatggtaaaaccctgtctctactaaaaatacaaaatttagccgggcgtgctggtgggcacctgtaatcctagctacttgggaggctgaggcatgagaatcacttgaacccaggaggcggagcttgcagtaagccgagactgcgctactgcactccaccctgggcaatagagtgagactcagtctcaagaagaaaaaaaaaaaaggtggtccaatgtattttggacatattttattttatatatatatctcctcatagagtcattaaaccgttggatatataaaagatatggcaaaatcctacatttagaaaaccatttaagtttgttgagtctagttcattataatgccttttggaactaatattccccttgagatatttttgatgtcattgttaaaaacaggctttgctgttgaagcccttaagacaaaatctgtttctattaaactgagcaaccttgggcaagttatgtaacctttctaaggccatttcttcagctgtagactagtggaaataacttctactcacatgatttgtataaaggatgggacgccatatgtaaaactcttactgaaattttaccatatagtcatttgatactagagaggctgatgtctttaaagtcatatttcaaaagtttgcttagggttaaccatgtgtaattgagtcttgcttgaattacatgctcattatgacctggttatagcattactcctcaaggaaatctttagttccctatagtaaacaacttgtttttgcctacttggtatttcttttcacctcttatggaaaaagtacttgtattacatatgatcctagtgagattatcaataacggtgttgatgatcatattgttaataataactatacatgacactcgctaagtgccaggcattgttctaagtgttttgttttgttttatttatttatttatttgagaaggagtttcactcttgttacccagcctggagtgcaatgctatgatcttggctcagtgaaacctctgcctcctgggttcaaacaattctcctgcctcagcctcccaagaagctgggattacaggcgcccaccaccatgcaaagctaatttgtgtatttttagtagagatggacttcaccatgttggccaggctggtctcgaactcctgacctcaggtggtttactcgcctcagcctcccaaagtgttgggattataggcatgagccaccgtgtccagccctaagtgttttaattcacgtaattcttatatcaaccctacaacatacctactataattatatcaattttagagacaaagatcctcaaaaacaaaacagaggttaagtaacttgttcaaggttataaaataactaataagtgttagtcagtagtcaaaccaaacctaaccaatagggctctagtctgagctcttaaccactgcagtttatgcagtgaagggcccctgttcctgtctccccacctatgtcagcatgagcatgtgacccaagccaagcctaattttgcagagctttatccttccaatatttgtgttcctggatgtttataattatgtctttctgctttctttcatcactctgtagtatttaggcctgaaagtagtatatagttaatatcacattcaaattcaggcttatagccctaataactcaaatgtgttaccatagaaatatttcagagagattcacatgaaagctttagactgctcattagtattccaaataacaaatgtgacacgaatgaggtatacttatatacagaaggacactaaaatatttataatttaaaataaaatttaaaaactaaattttacattttaaccctattacaagctaaacaatttgggttgagaccatacataatggttctttcttggatacaagctgacaatccataaaaggcctgcctatatatctgtctgtctgtctgtctgtctatttatctctcatctgtcttttatcatctatctatctatctcattgtttattcaggaatcagatgtaagactttattttttaagaaattacaactttctgtccacgtgtggtggctcacgcctgtaattccagcactttgggaggccatttggtggatcacttgaggtcaggatttcaagaccagcctggccaacatggcgaaactttgtctttactaaaaatacaaaaattagtcaggcatggtggcgtgcacctgtaaccccagctactgtggaggctgaggcaagagaaatcacttgaacctgggaggcggaggttgcagggagctgagactgggccattgtgccacttcactccagcctgtgcaacggagcgaaactgtctcaaaaaaaaaaaaaaaaaaaaaagaaaagtaagaaagaaagaaagaaattttaaccttcttctaataagcagaaaacacattttcaaaagtattggcttatgtattcttttggttggtcagataagtgattattgaccaaaaagggagaacatcgtcttttgaagacagaggcatgattaatatttaaatactttgaaaagagctttcttggtgatgtatttcatcttgccatgcacaactgtttagagtgatgctcaaggttttaagctaggaaattcttggtttgtcagagtactagtggttatgaactgggagctttagttctatataccgtctgactcaataaagtttatgtaaggctggagggctcagatgatggacctgccaggaatactcaagaattgaagctctttttaaggacaacaatgtgtacagtttttttccattgaactagacggccttacatgttttcagactggccaaggaactatttatttggctgaggtcactaaagctcttttttttttttttgctgccttctgtctgaggagaaaggagtaggtgaaaaagagaactgtaatttataaaggaaatgggaaggaataaaaggcattgtgagcacatactgtttagaatggatagtatttgatttactttaggcgtaagagtggagtgctggattcattccttcctctttgaactcctgtatcttcaaattttatctgtatccacctgtagctcttttccctccagtcccagaaaaagtgtcctttcttctgtagaagcaaatggctttacctgctttcagaagcatttgcctcccatctcttccaacactggggtctccctccaccagcaatcactgcttctattttatttctattctcttccacgttactgactcctgcctcaaagtttatgcatttattaattctctaatctcctccatctttataagataaatctacaaacaaaataaatatgattaaaacctgtagtcttttttagctaatatgtttcttctctctttcactttacagccaagcttttatcagagctcctagattttcaaatttcttacaccagtatttttttaaatgtgagaaccagtccagattgctaacaattgttatatctcaccaacttaatgtcatgaaagagaggatattataacaccacaaaaggaggagagatgtttatgattattccattttgacaatgttttatggtttacatagtgttggagtatagaattcttactctcattaactcctgtatttctttattgtgatctcattgttgcaaccagtgcctgtaattcacactttaggcattaccacattggctttgaatcaaaacgagtacaatttgattcagtggattgaattgccagttgtaaatggaaattatcccaagatgcgtatgcatttttccctgaaaatagatgattggcacagaatgtgtgttttcagtgtcaagacaggggtaatgtatatgattagtggtaaaaatatagactgctgtgggcttggggccaaaatcctgtcttgtattctgtgccagtccctttgaggagaagagctgactagagctggtttgctcagctgaaatgccttatgtaagctaccacactgagtctcataaaaggagaggaaaatgaactattttcttgactgaaactcacagaaactttatttttctttatgatgaaaaatgttaaaacttgacacaaatacaaaaaatgaagccagtgtagcaaaacctggatagtactgggagcaaaacaaaccacttccaaattgtaataattcaggttagttttgttcctgccatcctcaccattgataccatctctaatgaaatctcagcacatagtttaggtgaagtagttacatttttgaaactcactatagtatatattatttccagtgacaatagtatattcacagaaagtaccaagtattaataagtcaaaaattcttttgtgaaatgtatcttacctaaaatttttttgcttcatattttaaatgccttagagattcgtattattttagttattcatgctttccttttgtcagaatatgatagcatcttctaatgaatggttccattaagggtcttcgtccttaagctttaatttgtaagtcacatattttctaaataagacaataaagtcattagtaaagattcaaatatactttaaaaacaattctcataattctgtattaccattcttttttctctctttgctgtatacactatacatgtaaaatatcagtgtgtgcctgtattttcctacaccatgtaggcatgcaatgattacatgctcttcataaccagtatttctctatggccaaacttaatgtgatttttagaaaaaagtattagataatactcacaatgaattgtacaatgtaagaataaatttagacatttatatattcttagtacctggcagcttgaatggaatcattccacaagaacttggagagaagatcaaactctgatagtcaaactttacttatttaattttatttgatttttttgagatggagtcttactctgtcacccaggctgtagtacagtagtacaatctcagctcactgcaacctccgcctccaaggttcaagcaattctcccacctcagcctcccgccacgccccaccgccatgcccggctattatataggcacccacctccacgcctggctatttgtttttcttttttaagagatggggtttcaccatgttggccaggctagtctcgaactcctgacttcaagtgatccgtctgccttggcctctcaaaatgctgggattacaggtgtgagccactgcacccggcctgatagtcaaactttagttcatggcttctgtcactcagtgtgtgtacttgcacaggcacaggcacatacacacactggaaggtggaaacatgatcctaattaacccagaatgactatttcactaacttgactgaatgtattaacttacttagggcatgaaagtagtaagctgtagggcagttggtcagtaattcaaacaaggaaagaagggacatcatagaagattgccagtgagcaatcaagcattacctctaaagaaagtatttagttatcagtctttgacttttaggttcctggatgtatcagtatattctgattgttcccattaattcttatgtcaatctaaggcctcttgttctaattccaggctcaaaaacaattttctttttatcattgggcttttaaagaagttctgcctgcaggcagataatgtatagagtatgccatctatgaaaattaagggaatgaattttcttgtaaataattgacagtttctgttatgccaactgtgttggtataccaattattaactgagttaattctttctcacatgacatatttataaagtgctcacctttggagctagctttattatgtactctggggatacatacgtcaaagaacagacagacatgttgcttgtcctcaaaaagcctgtattctagagtagtgagacagacaagatgcactcacattgggaaaaacacagtggaggaaatgaacatagtgataagatgcagagaactagtggaagagggaaggggcagtttagtgtgggtggtcgggaggtgacatttgagctagatatgaaaggcttggaacttttgtttagcaagtgaggggaaaacagtttttcaagcagagaaatccaaatggtcagaacaggttaggatttgagtacctaaaggacaccagcataagatgaagccgaatagctagggaaagatcagactgactagaaccttgcagatctgtgagtttggatttttttctaaaggcaataaatgaatacattttatatctacatctgggagatgtccactccaagagtactgatgaaaccagaatctaagtttgtaaaggtgaaagactggctctggaatgtgggtaattaaacaaggtaatgaactgtaccctatgagatcttttgaagccactttctctcacaacctgtgcctttagactttccctacctatgttagagcaaaaagatgaatgatagcagaagattatatgtatcaacagtgttgcataaaatgtcatacttttgatgattattgcttcaaaacatataactgataccatattgctaactcagaaaatgatatgcttatttaggcaaagaaaggccacacaacctaaagggatgtaaatgcttttatttcttcctcctaccactaggagtttccaccaaaacgacgcttaagaattaggaacagaaataatagggtgacacttaaaagctgctaatagtaaccatatgtgatgatggatgtattaattaaagtgtcataatcattacataatatatatatattaaatcataatatacaccttgaatatgtacagtttttacttatcagttatacatcagtgaagctggaagaaaaaataatagagcaaaacaaagaaaggtttaaagcaaagtgaaccaataaaaggtatatgaaaacaagtaaccttttatggttccttctccctacaattacaaacatatggtagtatactttttttttcctactaagcacattcgggaaaacacaggatttatgctgaaagttaagttattttgtttgttttatatttatttttgaaaggacagaaaaagaattaaccaaattgcggagatggattggggtaagggaagatgtgatcttttaaaacttttaatgatgtataattcgatggcaccctatttagtatgtagtgaagcaaaaatatgtttactatttattttcggtaaatcagagattagatgagtaatctattggtagcatcaacttttaatgctttgtttttaagttggaatagaaacactcctcaagcacagaatctaggggagggtaaagctattcatcaaacagtgttgtcaagaaaacaaaagagtttatttctttccaaaaaaaatctgccatctaaaaaatattttgacctcatgtttcttagccatgtgggaacatactaaattcaaggttcagtagcttcaggtaatctgctctgagaccttgcaagtttctggagaataaagaccatatatacattatttctagtgtaaaaatcatgtaatatcataaaaacacattatataggaccatgacatttattaaacaaaaagttatataagaatttaacatgaaagatcattaacattaatgttcatttattttgtatgccggtatctcaagacttctcagattcttttagtttatcttacttttgtgtatcaaaatatttattggtatcttttagatttccttgtaacctgaaaccatcttccagagccagtttttctcatcatgcccttgatgaaagttcttgaacattgtgtgatacatgcagtatgacaataccttaattacaaagttcctttctctcttcatggatctccttttcagtaaaatgtagaagtctggccatggccctatgcctgcctcacatgatgcgcttatcatttctggtctgtgtttctgtcttcttgctttagattctcacagccctgtgatttgattcattttccatactactgccaatcatctttttcagattcaaaacttatcactttttctatcccaaattctgtaatggtttctcattctctttgttatgaaatccaaattattttgaaagtcaaatccagtataagcccttcttctccagccattcctctctataatccactcacacttccatttccctgaatgttcactttgtgccctgacctttggacacccttaattttattcctcagctggttaacttctcattctttaaaattgggctttctccacagaaccttcgtatgttttagcctctcttatctctccctcaatccaccctgccagctaccacaatttgtgtctgggttaagtgtttgtttttttttttctgacgaattctcactctgtcacccaggctggagtgcagtggcgtgatcttggctcactgcaacctctgcctcccgggttcaagcaattctcctgcctcagcttcctgagtagctgggactacaggcacgcaccaccacgcccagctaatttttgtatttttagtagagacagggtttcaccatgttggcccagatggtctcgatctcttgacctcatgatctgcccgccttggcctcccaaactgctgggattacaggcgtgagccaccacgcccggccaagtgtttcctcctcttgcttaaatagcatagttcttatcaaatggcagtgacattttctagtagtgtaacacctactatttttgtaactccttgaggtcaggaactctaagtctctactgatgagtgcagcgggcattcaataaatatatgcttaataaatgagccaatgcatgtttaattaagagagtatggatggtatagttgtgataaggccagacaggcctgccagttttcaaatattggctccactactcattagctgttactgaaaggcaagtaacttcacctctctttactttggaaaaatgagtgctataagcataactacctcagagcatagttgtaaggattacatcaagcagtttgcaaaatgcttggcctatcatcagcactcaaataaatgtttattattattattgttgcaaagggaagaagcttactgaaatttagtttctattttgccccttgcaaagcatactcgcattctcattttaaaacaagaagaatagggtaggatgtttttggaaaacaatcattgttatattgtctaataaataaaatatagtaaatgacataaaaaattgaaatctcttgtattttgaaagacacagattggggtattccaaagtacatatatcatagagaaataaagtgataatcactaggctttttatcttgcatgtcccttgtagttctgcgactcataactgtttatggacaaaaaatgttaaaggttgcccatgggaagctaaggatgtgtcatcagataggtccagatttgcatcctatctcctgctccttccaagctatgtaaccactaatggactacttgatattttctaattgggagttattctaatgaatctaatgtatggcatacacaaagctggaaaaagattttcaatgtatggctctgaaaatgaaaagaacagagggcataataacatcaaatcacttacatacctagaaaagcaacggaaaaaagcattacagcttaatcctttcacacccatattgtccttgggcagataaccagtggagtaattgctttacaaggatctagttgtcacagcacaatgataatacattgtactcttaaattattttatatatgtgtgtatgtaaatatttcctttgaggtaccatgaatgtacaatgaaatgcacaaatcttaagtttgaaattcagtgagtttcgacagaagcctacagcaatgtataacaaattactatcaagatatagataatttccagtacccaaaacatagttttgtgtctctttttgtgattgttcttagtacaggatttaaaatctctgttttcagatatcacagcagcaacctattttaggtggtagtgaattgatcattttacaggctttttaaaaatgtggaaattatacaagtggcagaagcaggtgatttctggctttaatactgttcagtaacttcttattacatcatggcgttgagagatgggagatacaggagagtatgagaacagcattcattattatgttcccttgcttaaagaagatttttgaatacagatacagatatctgacttgttatgtgtcatatgactgcttcttatagtttttggctttatttattcaaataaatagataaatatgtacaacagactctctaatttttgaaaatatatgggaaaaggttattaaaaatgatacaaatcaagtcctgagatattcttgtggcaaactgtaagtgatttttgattgctgatagtctgggaaaaatgctagtgatagaaagcaattatttcatgtgacaggtatttgaaattaccagtaaaccagaactcttgtgaaatcttttcaagaaaagaagaacagacaaaagggccattatttaatttcttggaagaatgctatgtactaaaagcaaaatgctaagtaagaaattaaattaaaataaagttactatattatgatgttagaagttggtatttgttaaaatttgagagctaacacataaaattattgcttaagcaataacaatagaagcttagactcctactagaatagtgaatctcctcagagaaaagataattaaagccactaggtgcagatccctaagaattgcctgtatgtacctacttatgtgatgaagttaaaaggatatttcaggatatatccacaggaaattatataagattttatatgttatttaagaaacaaaaatgctttcctacaatgagaatttatttttataggattatgcttttctctctccacgtagtattataaagcttccttaaaatgcaggagaattgcagaagagcagtagagacagttttgcccattacttactactgtggtttgaatgtattccccaaaagttcttatgtttgaaacttaattcccaatgtagcactgttgggaggtggagcctaataagaggtgattgggcaatgagggtggagacctcatgaatggattaatgtcaatgtctcaggaatgggttagttatcatgggagtgggttattacaaatcctgccactggtgcctctctctgtttacttgcttgcttctgccttcaccatgggaagaccctcgctggtgctagcaccatgctctgggacttgacagtctccaaaactgtgtgccaaataaacttctgttctttataaattacccagtccatggttttctaatatagcagcagaaaatggactaagacacctactcaccaatcattttcctatttccccccttctcaaaactctcatactgtaactgtcataaaatgtagataggattatgtaggattgatcctaggcccagcttcagggataggttctgattggttcaggactgagataaaatctgtctaagccaatcagcacaacatgcgtgcatgattatagagatcacatcaagggtattttaataggtgggttcagtattattgtttgatggttgtgagaatatgacccttattctcccactggacggatgaaaaggatgatttcaggtttatttccaaccattttgtaactatgaggttagcaatgctgaacatgatgtgttaaagataatgctaacatatgaagaagttaagaaccaaggaaatgtctttctttagccagtcaaaatgatctttcataatctggttctggaacaccttttcagcctcattttgtttgttccctacatttgctttttaaccaagccaaatgatcctgcaaagaattccattcccggattattgtgtgctttttattttatcctaagtctttttttctacaagtccatgtacccagaatcctttgactaattatattccttgaatgcctagccaacatttattccttaagactcaactctagagtaactgtctctttgaagtatttcctagtgtcttttaccccggttacatctactgagtatggtgctcctcctttgtgctcccatgacaccttgggaaaacatctatgttgaattttaagagggcatttttttttttttttgagatggagtctcactctgtcacccaggctggagtgcagtggcgcgatctcagctcactgcaaactccgctttccaggttacgccattctcctgcctcagcctcctgagtagctgggactacagatgcctgccaccacgcccagctaattttttgtatttttagtagagacagggtttcaccgtattagccaggatggtctcgatcttctgacctcatgatccgcccgcctcggcctcccaaagtgctgggattagaggcgtgagccaccgcgcccagctgcaagagggcatttttttttttttggcctttctctcattagagcatgtttaggataggtgtttgttgatcactgtgtccaaagaaccatctattcttccccaatggtactatagcaggattttgatctactgcatcaatgctctgttttataatttgagatgcagctgcattctgtgttgtgctcaaagtatggaaaaattattcttcaattggcaataggtgcaagaaaaatattacttgggtttgcaaggttactttcagttgtctgaaaataaatcactttgttcttcaaagtattagcctatgaataagaaaactcttggattttaatattctctttcatattttcatgattattaaaatcctcttttaaatgactatgaaacaatgtgcttgggaaaatcaacagcacagttcaaatggggtcacccctgggtgtagtttctgtgtgggttaaagagctgtcctctcttctcaggtcagcagaagggccttcatctccaatgatcagtcttccaaaaagagggcctagggaaaagaaccgtcacagagacatgaatggatctatggaaatcttccaacaatttagaaaaaacagtcaaagtgaatgcctgattgctgaatgggcatcattaaccttatgcatgaagtactttattattatcattttattatggttattattgttattatttatacacatagttgtgacctatggcaacttaaaatctccagtagagttaccactggagcctctgtaatatctgcagatgttctgtgcttggcatgcccagtgttttaaaggtggtagataggtggcagtataactggctgtttaatgcctattgcttagtcctggcatttgtgttatttcctggtttcatttccctaaaatagggataacttggcttgttctaatcagatattaaagtttttgttaggaaggctaagggacttcgcccgtcccctgcccagatttcagtatttcatagaattcacatttgtttgtggtacagtatttttttctttccaaattttgggtttactgaatagtgaattgataatgttaaaacattaccagtttaatttgttttaaggaaaatttaaaaactggataaaaattattatggaggctctttccttgtagttaaaatatttaaaaaatgactttgtcaacctgatgtcatcaaatcaaaacaagcctgtgttttcatgataaagcactagctgattcagcaatgcatgcttggatttactttggacagacctcagtgggtcttgtgagaaggattgggccttttgattttctttcctttttttttttcttttttgagacagggtctggctcttttgctggagtccaggggtatgatgtcagctcactgcagcccccacctgctgggtttaagccatcatcctgcctcagcctctcaagtagctggggctacagatgcacatcaccacccctggctaatttttgtatttcttgtagagacagggttttgccatgttgcccaggctggttttaagcttctggcctcaagtgatctgcccgcctcagcctcccaaagtgctgggattacaggtgtgagccactgtgcctagcctgggtctttctattttcatttccagagccatacatctgtgttaaatacaatagaaagaatattggtaaagcttttactgtcaaatacattacttactgtaattgtatttccccacttcataatcaaaatttctattttaaaatccccaaaagacctagaaaagtagaaagctagctaatatggctgacagtctgaagacttctacttggactctgtccagcacattttgacctcccttcttctcaaagctggagactggtggataagcaatggacctggagaagtggaagaagaccctagatatggggtgtcttctttaagtgtgtatttgtggggtgatggtggggagagaggtaagaatgaataatatgttgatatacaatactgacagaatttaaccaaaaggacccctaaattccatctcactcacacccatgcctatgtctatatcatcagccaaatatagttttttattttcataaagttcagaatgatctgaatattcctgcttttaagtgtaaaacacttttacagaacaactagctattgggtgaacttctataggtatctcaaccatttgtgagctgatcaaagaagaaagtttcttctcttagccccctacccttcaacattctccctactctgcaaacaaacacatacacctacactcatacactcacagatcagacagggcttaaagaagaggctttgtcccatttatgctcataaagtatttattaaaattaaatgcttctcatgcacttccaaaaatgttctatgatgtttcttagatgttcagttctcaaataatagtagattggttaatgaaatatgatctgtttatggtgccagatatttattgagatgaactacattcactttctgctatcatatgagcaagaacaggtgcacaagtatatttttaatgtgatatgtataaattaaatgtatatattagtatctctacatatgcataaatatataaagatatatatatagatatatacatatctatatatgcaaagacagtacttaagatattaactgagcgggctatagagtatttgcttattttgcttatcagtattttctagttttttttctacaataaacatgaggcatttataaaataaatgaatattctttggtgtcttttaaaaaacctagcaatttattaggatacttggacacagaggtttaggtctatgaagggattattatgacagaatacaaatgatctctatacatagacaatagaatgtcagacctttaatgaggtgaggtcactgataactatgaagtcatatagaaaaaatttaagttaaatgcttataataaactacaaactatcattgaaagaatgtttaaatataaatcaatagtttatgttacgccagaaggtgaagataccatgacttttataagaaaccataacatacatgtatctttaatgttaccagtttctcctagatcaaaatggagaattggcaatcttccctttaaagtgaattttacaaaactaaccagttttctaaattctgtgtgtgtgtgtgtgtgtgtgtgtgagagagagagagagagagagacattttgtgtgtgtctggacaatcaatttacaacattttagattactgaatatttacgaaagtcttctaggaaaatttggggttgtatttttgtattcataaaacagataatctcaccaattttatcatatgctgtgtttagttactccatttttagagtttttttgcatctttggaaacaccaaaccgaggagttctgtcctcttggaaaccattaaaggcgaatttcaattgtgtaggggagacttctgcaagaataaagaattatccagggatgtattcaagaccaaagcaaattatgcatcagtgcagggcagagtaagctgtaagcccaaggggattcagagacttttgcctcacctgtgatgacagtgatgtgaggaagacagtagacactgacattatgaaaccttaatattccatggctggcatagtgtttgccacagaattgctgtgcaagcaagacattgtatttcttgtttggtgtcagtgctgctccatatatggtggaggaagctttatgctttgttagaaaatcggctctgagctgttgctacatctattttattccacttttcccaagtgtgagaggcagtaatgatcaaagattttttcctatgtataattcatgtgattttgatggaaagcacattgcaattgtctgcagcagtggaatatggttaaaattatgcattttaaaataatactagtagttgtgtttatataagtatgttaaagttggaaagttgggactgttagggaaagattgtggaaacagatttttaaatggccttagtgacatcacatgaaggatgtgatgatacttaaaaaaaattaagcactactgtccatggagaaaattttagaggacactgtatcaaggattcctaagtaatgaggcttattcttattgagaataattttccttcatgtgacctgtttttgtgtggtgattatttttgtaatcataaccattctgtgctttttttgtttttttgcttgctttttttccccttgcttaattttattttccttttattttaactgatgttaagacgtcaggtcatgatattatttcacttccacttgttttccagcatacctcttagaagttattagttgattcagtttaacacaggttagcactgtttggtctactgtagaaaaccaaaactaagcctaaacatccaatttacacctaaaaaagaggctgcaaagaacattttaaaatgcaatatgattaatattttagatttcttgcttcttcatgctcacttccttcgttttgtcttatgggattatagaaacgcccttgataaataaaatgatttctgggtaggtttagataactcatcctttagtgtcataaaggatttgaacttaaaagctgattaaaatcctaataaatgaagctacatatgaagtattatttatcgagattaaaatgaaaattttaataacaagaatgcatgttgtttccatgaaatgttttcccttgagaagtttaatgtctttgaagaaataataaaacccacaaattatctcattaatgtgcacattaactaatgaatgaaaactcccctctcacttaaagatacaaatcaaggtgaagtttgaaagagtttctacatctaaattaatctgttaaagaaagagtgagctcagcccagaaaatctttaagtctttggtccctgttttctttatgaaggcagtatgagatttctggtcaccttggaaaatggaaattttgacctttaagtaaaagaaccactaaccatttttaaaaattcaaaattagagctaaatgtaaatagttctgtaatttcactattttaggttatatagaataaagaagaagaatttgggattcgctacatgtagtaagaaaactacatgtgttttcttttgtctgcacccatgtagcatggtgggagtataggtaagccacatggcttccctgtacttcagcctgttcacctctgaagggggatcgtgacaacaccttgttcatgggtttgttgtggggaataaaagagataatatgtgtaaaaaccaaaacaaaaacacgtttgcttgtcaaataacaagtatttagtcattgttggttacttttataacaaattgattaatattaactactcacaatagcaagtaaatatttggatagttactcgggtataattgagaattttgtgtctctattgtagaaaaatataagagtcaatcatatgtcaaccatctttaaaaaatatttataaggcataaaccctactgcagaattgaattttaaaggatctgtagctaaaatcagccaggattcttttcttgtttagaaatttgtatgaaaataaaaattgtttcttaatggtgcctctgaagggtgggatagtggagcatgcagtagcaggatggagagaacttgaaacaaaacagaggtaaaagttaaagaagagtttagctttatacaccatctttaaaggcttggtttcattataaaacaaaatatcagaacagttcagtttaaaatgttttttatacagaatttaaacagatatttggaatgcaaatatctgtttaacatatgctaaaatgttttgataacataaactgtccagagttgaaagtacagtttttgaatactttaaaaagtttctggacagcctgatttatggttttaaaacaagataaactttcatggtacaatgattatttcctaaccattacactaaatatgattctaaggcataccctttattttaataaaatgtaaacaaaatacattttttcttgctcttacaaagtatttaatttttctgcaataaattcagtattgagtctgactcataaaattgatttggaatgtgtagacgtgtgtaatagacaacaaacaaatcaagaaaaaaatcaatgcagtgactctatttggagaaggaaaattttctatatcatataatgaatatttcttctgtgttattcgattttctgaataagatctcttgcatttgacagaagtgtgttctttcagtgattactgctataaaagactgaatgccggttagcatatgagcaagaaaaagttgactgtatttgaaaatgtgcagccagaaaatcttactggtagaaatgagtatagattacttaagattctcaaatgaaattctttgtttgactgaaaggtaaaatagctgtagtgaagttgaatatgagactttaacaggtttattctcacattgtgagaactgctgtggctgctccatatagttagctttgtgttaatttctttttcagttttacatcttagattactttcttctgaatatgtctcagataggctagagaattgattaaaatatattgtattaaaaattattttagtatgatgtattgtacactcccttatactgttcttatacgctcccttatacggttcttactcttggcgataaaattcatttactgttactttaatgatattcagatttacataatgtcaactaatccctaacctaagtcatgtatgccattaggcattttcacttttttccccctcttagcaagcctcatagcattcttttgaggatatattttatccttcttatgcgagtgaaacaatttaggaagtttattggagaatgattttaaaagcttaatatttaaatggctaaatagacttcaagaggtgtcatcatcagtcggctcttatagtccagaaagtaatatgttctctgtgttaaggttttcaataggaccatactgtgaaaaatgacacaaatttaccgcctaggaattaaaaatagtagcatatattcctgctcttaccttgccattatattaaattaatactgttgatacagtcgtatttgcactaaacatagaaattaattacatatatgtgactgggcccagaattaacccttctgacctaattcccccctccctcccttccatgcatccttaaacatatacatactgtctttctcttcctcccccctctgcttctttctccatcaagcactctagaataattaggagattaggatctgaaatgtgagatggtgatggtataagtagatctcttgggactccttttgtcatgaatccccaaattgatcccacagatttgaagtgagtattcccaggatgtttgagatttcattgtggggtattggcttttcctcagctgtctgaccttaagcaggtctgaaaaagcaattcagtgtggcttcaaaagtccctgaattaatgcaaaatatagtccagattagcactattctctctgcagttaccttgtggtgtagagaataaaatatagaaaagtaaaaagtattcaggtcaaatactgaaataggaagacatggctttatttttaataagtgataatctgttaatgtaaactattagtaaatcttacaaaggtgtctgattcgtaatcagggtcataactactgaggaaatcttaaaaattatttttaatacacatgagttatatcagtcctacatacaactggtagaattttaacactgagaattcgatgccacttcaaagatgatttaaggactgagtgagatccctaggtttgtatactctccattcagttaaaatcgtaaaatatttccataactatactttatgacacctttaaagtaagaccttaaagttgcttttttttttttgagatggagtcttgctctgtcgcccaggctggagtgcagtggcacgatctcggctcactgcaacctccacctctcgggttcaagtgattctcctgcctcagcctcacgagtagctggagctacaggcgtgcactaccacacccagctaatttttgtatttttagtagagacagggtttcaccatgttggccaggatggtctcgatctcttgaccttgtgatccgcccgcctcgtcctcccaaagtgctgagattgggattacaggcatgagccaccgtgcctggcctaaagttaccttttaagtaaaacataagtggtgtgttttaagaatttagtaaaataaattagttgatgaattattggtacataaagcaatataaaagatacggtttgtgagaattctttgatgtatttatactgccaagtcagtaatacacttgtatttgcctctaaactttgagattttaaaactcaatgtatgattcatgtccttatgaaaggaggctaatagttttttaaactcacataatagatttagatccaaaatataaaatgagattattagatcagggttgaaattcaattcctgctggagcttatctatgatggcagaatggagaagatgaagggatataacatagattgagatccttttcctttgtttgagagatattattttacttaataaccaaaataaacttatgagttcagtagtgttatttttactgaggaggaaaccaaggctcatagacattaattggtcccagtgatgcaactggtatgcctgagtgccagggatggggtttaaacgtgggtgtgtatgactccaaagtcaaggatccttttcttattccatagatgccctaaagtgagtctaaaattgtagttcataactgttcttttgcacaataatcttagtgctatattcatttctaatatgtcaattcttagctaagcaaatagcatctacattatttattgcttctttatacttaatgtcctaatctttttaccatagaccatggaaagagcactcttataagctgagatctcataaatgtgtagaaaacctgaaaacgagtcccattgttggggtggtaatgtgtatgtatacacatcagaagcacagagtcaaattccagtagaccctgcagatagggtaatgacctccaatggggccttccagccttttacaaagtaattcactagtcaggaaaatgcagttgactcctaatctaatgaaaaaaagagacatttaggctacatgacaatttaggcttcagtattatttctgtggacaactcttccactacctttaatgataggggctttgatatttttatgatggatattgataatattattccttgtctctttctagtgaaaagctttgaagcgcaaagtgcttcttaaagagaacaataaatttactgcaataaatacatttaaatagcacaattatttttacctactattgttatcactactaatgagaaactttaaggaaatgtggaagcattactatagcggtgggattttttcagggacgtggggtctgctgagtatttaaaaagtattgtcaaatcatgattgtgtggagctaaaattctgatttccttatggtgccttcatagaggcttgatttttttttttttagaacagtacaccaccaaatttatcgtattggttccatatatagctttatttgaataagtttttgccatttgggggcaataagatctagccatttaccaatgagcgtactgattcatattcttattttcttggcatagtagtatttctaaaataatattctgtttttcttaaagatattagagaaaaagggagaaatgaatgtaactaaaattcattgtaaagataagcacagtcattactagtttctattggttgctattttcttttcatcagttgaatatattacttacctcaaaatgcccatatcccaatataccattcatctactcaatgattttattttcattcaataaagattgttgcatatctatcttgggtcagatattgtgattagttttgagaataataaaatgaaggaatccaattgccccgtttattcccaagcaatatctagtctatttgcaaggacagatccatcagagccaactctaggtgtggcattatgtgatgacagttttcatttcaataaacatttaagagtgacttctgtgtaacagacatacagataacactgacgatacaaaagtgtctaagtcaagatccaagattcctcttctcaaaaaacctcatagattcttcttgcaaatagatcagttactactgaatgtggctgaaccaatttacacttccaccaacagtgcataagcgtttcttttttttctgcaacgttgccagcatctgttattgtttgacttgtaataatagccattctgatggtatctcattgtagttttggtttgcatttccctaatgattagtgattttggactttttttcatatgattgttggccgtatatatgtcttcttttggaaagtgtctgttcatgtcctttgttcactttttaataggaccatttttaatgtgacttattagtaacttcattatgtgtttgcgaatgtctacttgtgtgatataattttgcctctcccctatgttgtagatgattggttcacaaattgaggcgtcaaaaataagaacacattcaaaaggttagcataaatcccctcgctagtgatagcatgagaaagtgtgggtatgttacatgtgaggtagtggtgggacactactagaagacagacaacttaaatcttattcccctcttatatgaatttattgtgtgattttctgtgtgacaaagtttcaggacctctatcttttcatttcctcattcacaatagaagatagtatctattttatttaacatgtaagatgttgaggggatgaaattggattgtaatatatatgagatagtgtgtggaaaaaaatattgtgtaactataagcaaccatgagtaacagtaatgagtagtaatgtttatgtcatttaactgtactttattctttatatttagtttttaattgacatctttagattttaggtaagctactaattgcacacatataacttgtgctaatgtgttttatggtttgatgcctttgtatctgattctttttaatatataacaaagcaactaacatagtgaccaacacatagtgaagtactgaatatatatttgaatacactttgtaagttacttataggttatagcatattgaaattaagctctttcaagactctctgtcctatctttgcaaatgcttatacttaatgtgtgttttagcttgcaatctgtactttgctttcagaaaataatccaattagatcaaaatgttaatgtgagattataaattgcccataatttgattataaaataagaagtacttaaacgaataaggtttgagacaacctagtcatacctgatgtatagcccaatagaacaaaatcacagaagattggaggtaggaaaaaaaacaatctagaaaacatgatataagtatatatctgtgtgtgtgtctgtatgttttgccaataacacatcactctgatgccttatgttcagtaaaaatttgctgatctagctttagaagttttagttattagactgtctttttatttcctgtctttattcaaattgaaaatgtcagggggaaaatgattatcattagtttagtattttgaaatgtattaagagtgggagacttgtaaaattttttttagaatttagaacatatttttttctggtctttactttttacataatttatataagggttgggtaaatacccagctatttaaaaaagacactttaaataagtaccaggttatagaattactgtggtaatttttaattttacaagtgctggtttatgatttaagtggatccattaaaggatatttttatttataattggattaaaatactgagttagaaatgtaaatggatttaaccatggttgaggaaggagagtctctttagtaagttcctagtaattggattatttattattttatttcagtcttcatacaattttaaaatttagagttaatatcacctacagtaggtggtaaattagttttatggcatgaaaatctgccgtaagtgaggaaatattaagaacatggtgaaatagagcttaaaaatactgttttttcttctacttttgttatatcaagttataggcttttataaaaagctcaatgtaagaaacactactaataagaaagggacaaaagcttttaatagctttggttgaattctccattctaatattaatcagtgaagaaaatgcttactctaagtcaatttttctgatatacatttgactagtgaagagattaaattatgaatgtcacatttaatttaaaactaaagagagaaatagcactatcacagggaatgtgctcttttgtgaatgtcaagtgcaacttgttgaaggtcttttgaaaaacgtgtaggagagatgttgttgtgcattagttatgcatgtctagagtacctatcagtttggaatacagatgccatattatactattgactaccactgtttttaatataggttgggccctggaatcaccctctggtttccattggaatggactgagcctatgccaccctaaaacagaatggatccaaaggcttttaaaatttgtgcagaaaataacatttggcctaggaagttgggtttcacattctataattcgctatttattggtaacttgttacgagtttctagagaggatttttctcttctccgtggttgctttttcttttcaaatattggtttccctcgacaaggaagtgctgtgtaactgagaattttgccaaatgttagcctactcatttctgttcactccttggcttttcacataagaatatggggagggttaataggcttaatttatgtatacctcttccacagttcatgggcacatagtcatccgcatatagagcaggtgatgagtacatttccattagatgaatgaggggaatgagtcatggaaatatccatttccttagtacagagacattactggggttcatacactgtaacattttaggactacatccaggccattcttgtcctcttctgtattgtccagttggcttgtcataatgttatctcaaagccgaaatatcctccaaccaccagagtagttagacaatggtgcttggcatttgaggaaaaatctttaaaaaatgaaggaaatccagatattataaaaacatgagaatgaatatgaaagatatggcatgaaattttaaaattagaagagtctaagaacttgcatcaatattgttaaaaggatgaatacttctgttattccagcatttattattactgttatcaacattttgcttccttggtataacaaaatttaaagtgataatgtgaggatggcatgagcgactggaaatttaaaaggatcattggatatagtgtgaattcataatgtggccagtgctttagaagcagcctgcccctcccatcagggaaagttcatttgcctttggtgaggattctggataacatctttgaaggcactaaagtattaacacagggccacaggtggaacagctggtttagttctactttatactagcacttgtgtggaatatttctttcagaagacaaatgttatatttttatctgcagagaggagtttattttgccgaatgtaccagagagaatatttgaacaaaacgtttattgctttgtatagtttaccattccaactgttttgtaattttaattttaaaaaaaaagaacataatttaagcatatcattgttagatgttattttccttttttagtgtgctcacttagccaggggagcatattttggtaattttactcattctcaaatttcacctcaggtcatcaggttagcacagactggaggtgcatttattatttcccaagtgataaatcgcagcacttgaacaatagtggctttattaataattctcacaaacgatcatacttaatactaattctgtttaaggtagaagtctgttgtgagttcagaaggtacagagatacgcctgttttggagacagaagtagggaaaagtatcttgcttcaaatgtgtaacatgtatggggaaaacccatgtgtttcatattcattttactttcaaaaatcaggtttgtatgttcctaattgttttcttatgtttacttaatttttgagaatggattgattttattttcaatgttatctgcttcctggcatgcttaaacaattcaaagaagatagctacggcccccttgtggttaaatgatataaagttgtcaagatggaagaatagctattttttttctaaagtgatattcttgaaaattctaaggctgtggcttaaaaatcataaaattgttacagaggcaataaagacatcagttgcttatttaatcaacataaagtcaaacatccaattttttatgtaaataggtaactgttcaggctgatttgaataacatctgcataattactttccttaccctaccctctgtgacattttagtttagatgtatgggtaaggtagtaaaaaatatattttttaggttgttgaatcttaattataaataatctaatatttaaaacctattaatataggaagatgtgacacagcatatattatgtatgtgcttttgatagttaaatcctaacattttcattacaataattatctagttccacacataattcattttatcctccattaggggaagcatcttgaaccatttcagagaaatgtaaatttcagagaaaagtaaattattgaagatttttctcctttgtttagtgttttatgttctacataaggattaaagaagttgctatcaggaagtgtacatttgaatgcatacttcaattaataatttatcacaaatgggataagtagtggctcttttcacagttgtgataaggctttaaattatttatatcaaaaagatgttgagtttgagggtttgtatcctacctatggaaacaactttatatacttagaaaaaataatcaggatttgggccaattgccttctaaaatagcatgtgaaaagctatataagattgtttaatatataaatcttttgacttaaaatatgaaaacagatggtagtgaactaagcaggaataaatcctgttatgcaaatataactactctctgcgagttgttttagggaaacataatctttttagttttgatgtggttgtaagagtggggaaaaaaaaaggtcctgtatagtatgcgccaactgataggtattcaaaggttgtccctactagtgccaatttgatattactattttcatctggtgtacttcacttgatctcatgggataaacttctgtcttcagggaagaaatggaagaggtagcagaaattaaatgaatacttcaataaaggtcacagaatttatcagagctttgctagatgaaaaaaaaatctgtgaaggcaaaactaatctctggtgttaaaagcatgatttctgggataatggtaatttctgttttttgatgtgaatgcatcatatgaatatgtttaccttgttaaaatttatacacttttctgtatgtatactgtttttcagcaataaactgacaaaaaagaggaaaataatatttgtgaacactggtggaacattgtagaaatgttcatgttgtgaaaatagtaatatgtcaagaataaaataatgtttgaaatatagttttatgtagccatcactatataacactttataattaattctttcacctgaaataagttttatgaagtgattcttctttataattaacccaaagtcagaaaaagtacagtatctcccaaataatcagttaattacttccccgttataagaaatttgctagctgattttcaacgtttggacacgtctgcttgaaggcaatcctggagtatctgtgtaattcgtttattaattttttatgtatttagaatgttttagtagaaacaacctgatctgtgttttaccttaaatctatgtgacctcaagcaagtctttttttttttttttttttttttttttttttggagacatctcgctctgttgcccaggctggagtgcaatggcgcggtctcagctcactgcaacctctgcctcccggattcaagcaattctcctgcctcagcctcccgagtagatgggactgtaggcatctgccaccatgcccggctaatttttgtatttttagtagagacggggtttcacagtgttagccaggatggtctccatctcctgacctcgtgatctgcccacctcggcctcccaaagtgcttggattacaggcgtgagccactgcacccggccaaccaagtcttaatattagaatctcaatttgtaaaaacaggggcaattattatttacttcgcagcattaaattagatgatactgagaaagcccatagtacaaactatggcatatgatctattttcaactaagtttagctttttactctttttctctatggaaatcttacctcaatctactgttgaaaatggatgatttttctgacttgccagcagtacaaaaaggcgaacatttgttactttaaaatatgcatcatttaacgaaagcattatccagacaaatctttatagatggtggttagcaatgtgatgggtataagccaaattagaatggtttcctaatttggggtgctatttcttcacattttagtattctgactatttaaatttgtaaaactggcaaaaattattttggaaagtaaatttgttttaaaaacaataaatatacacatactctttggctcgtattcctattgctgagtatttattctcagaaaataattttaaaagtaggaaaaatactaaaaagccacaaagatggaatagtaaaaatctttctgtggtcaaaatgtcacagagtaataaaatagaatgacagtttattgtgggtagggtattacataatttaaaaactaatattatgaagacttggttataatatggtcagtgttccttggggaagagtaaaatgtaaaatgtctatgacataacatgacttcagatcaattgtaatatcatgattaccattatttttctaattgtgcatttgaacaaagactttacaagaattaggaaaaaatgtaaacatttatcgggctacagtggtggaatttggggtgatactatttctttaatgtttttatgattttgttctttccatatgggatgggtgaggtgaagagggaaagtgcataataaatgtaagggcagtttttaaaaaaatctgatctagtacatttttcctctgaggctgatttctacttactatacaatgtgattttttttaatggcaatttatgaaaaatctacaaaattgaggtagcttaccatggtgctatgtgtttggtcccctcaaaacatacctttgaaattcgatctaaatagctctttgaaaatgtgaatggtgaatgtcagctactaaacaagcacagttaatgcagctgcaaatgtgaatgttctgaggcctctggaagctgccagattcagtggcccaactgtgtttcctattgcttcttcttatgccttatagtagcaacattcataatacaacaggatctctctccatcccaccttggggttggagggcacttatttgaatgctgaggtgagcagtctgtgttcccagagcaggtaaatgtaaacatttgctttcttttctcttttggttcaagccctttccagccttccctggaaggggaggacttgagggcaggttcccagtgctgagctctgaagcacaaacaacaaaaggaagggcgaggaagtctgatttaatgaattttatcaagtgtcataccagctcattaaaagaacatttcaagaggaacatttgctgacatggctttttgaggattcatttattccacaaacattgagccaaacccttcatgtatcagaggtacagatgtgagactataaagatgaatctgacttggcgcctgcctcaagcagcttatataagggagaagtttgtcatgcttagttcaagccttcctaaaatccaagcttctttctctttttatattacacaaaaagaaagccaaggatgcttttcttatactggtattctcagagatatgtatatttccagtagatgtaaattaccttttacataagatagtctgtgtatttctagaagaaatgaaaatggcataatatctgcaatgttggttttttgtaggataaacatttttaatgcaatattttaaaatagcattaccatgaaagaaaatacaggattcaggttgcacccatttggctaccaaattccttcttcagttttagttgaggaccaatacatgattcttgcgcgtttttttaaattaaagaataatttttatatttatcaaagtgaaacatatgcagtcttagatacatttccagcagaaatgtgcagattggcaaaagacatgtactagaatgttcactgcatcacaatttttcatagctccaaactagaaacaacccaatataaattgtgaagcattcattacactggagtgtcacattgcaaggaaaacatacaaaagtaaggacaaaactgaaacataacattgaatgaaagaaactagacaccaaatgtggatactattctctgattccatttcaattaaatataaagcaggccaatctactctgtgatgttagaagtcagcatagtggtcacctgttttggggaggctgtggtgcctggaagggagcacaaaggagggactctagtcacaacctgttccttcacctggtgctaattacacaggtgtttcagttcgtgaaaattcaccaagttttatacttaatgtgcacttttctggatattatactccaacacaaagtttaaacattcacagttaaattacatgaatagataaaaatgtgtaacaggaattggagctgtgcttataagaacatgttcctccttcacctacatttttgtggcaattataaataaaaccatacaaattagagcagtttattcaaagctttccatagcagccatcatcacatgcatttggtagagactcaaagtaaagcaggaggctggtcatggtggctcatgcctgtaatcccagcactttgggagggcaagaagggaggaatacttgagcccagaatttgaaagcagcctgggtaacaaagtgagaccctgtcaatattaaaataaaataaaataaaataaaaataaaaaaagtaaaccagaagtgtgggaaaggcagagaaagaaggctctacgtgtgctctgattgggattgttggcatgagaacatgaactagttcacctaggaggtgaactaggtatgtgattagtttgaggagcatattagattttctggttggttctgagttggaagcagagaccaaaaaaataagaaataataaaattgggagttggcagtctgtgatcgagctctgactattctgtgtaaattgtctttctaggttggttgcttcatagattgtgggtcagagttctactgctatttatagtttgaccagtgtgcattctatcttcagtctcattagagtagaaatcaagtggagcattatgcagggaacaaggaaagtgaggtgctctgaaagggccttgcgtttggtgcatttgggatacaaggtttgatgtcttttgttttgggagccaggcctgtgatttgtcagttctccaaaaggagttacactgtaagaagctacctagtaaacccatatctactagactaatctaatggggatatataatggaaagaattcattatgtaaagtggagggcaaagcttgtttaaaaattgaatattccctttcttgatggtgttattcagaaaacccattaaatgctaccaaattttttaaaaagccaagattttctgtgacatatatggaatagtcattctcaagctaacattagagtcatcttagggtcttagagaacattagagtcatcttaggagcttttaaaactgcattggtactggtcttgcaaccagagatcccagtatgattgatatggagtggggcacaggcactgctatttcttaaagctgtcctggtgattttaacatgtagctatagtgttgagatcactggtttagagcaaagggtagaaaataataataataataaaacgtttgcagtgggatggtggtttcatgttttatatcaagtatcttatatacactattttattaagttctcaccaccaccctgtgaggtaggtgttgttactgcctctctttcaaagattagaaaactaaagctcatagcaattaaatacttcatgaagtcatacaatcacaggcatacaattccttattcacaatttcaaaattcagaaatctctaagaactaaaatgtttttgtaactaattgttaacaaaaggtgatctaaccttggattgaattaccatgcatttccatgatgtataaccaagtaccacaagcttgtcagcttaaagcaatggccatttattacctcacagtttccataggtcaggaattgggtatgacctgacaggatcttcggctcaaggtctcaccaggcagcctattatcaccttatttgaggtttgggatcctcttccaagtttatgggttgttggcaaaatttactttttggcagctgtaaaactcatggtggcttgcttctgtaaagtcaataggagaaagcctattttccttatagtctctgactactagatcctcatttaaagcattcataagattagcacaggtccacctgagataatctccttttttattaactcaatatcaactgattaggaaccttaattacatctgcaaaaatccctttgccgttgccatataatgtaacatgaatgatgtccatcatattcactggccccacgcacactctagggtaggggattgttataaaggacatgtacagccgggggtacatgtacacttggggttcattttagaattctaccctccacagacttgagctattttagaggcaaacaatctgacctaaattgaggtgaggatatataaagcctttatttattatacttagtatgaatagtcactgtagaaataatgtgtttgagtattggatactgggaatgttaataaaatatatagactattcactgtagttttttctaaagttaaaaaacatccaaattgcaaaatctctggctttaaggtttcaaacaatggtttatgaacctggaataagtagcagagcagaagtcagtttaatcaagtctagagtaactctcttaactactcggctgtactgctatcaagcaattattaagctatgttagtccaaggaatttcccttctacattctagggacatgtttatccagagaatccaaactagtcactattactgataagtccatattttcagagttggaagaaattttaatagcttcctaaactaatcactaatctgatacatgactctgttttatcttctcagggcccaaagtgtagagccttgcccaaaatcattaccaagttgtcaactttgtcattatacaatttattttctatttctttcagatcagttgcacttgtgtatctcggctcttaaagcctcttttctgctctctgtgaatcatttgagaccatagtaatagtttcagcagatttgttttcaagtcttcccaaccttgaagacttgttctttcagactgaaattcctgaactcattgagaatggataaatttgaactcactcacatagtggggaatggataccattttattgttttatttttcaactttatatattctaggctctatattgatctctataataacacctttcagttgtactaatctgtatccaagattttaaaacatattttaaattactaacatgactttggataagtaataagtgccaaggtaatataaaatcattgtttgtccttgtgcaaataggaattctaatatttttctgtattttatataaggcaaagggaaggccttctaccccagcttttatagtacaagttaaactgggcacagtgcctgattcacctgattcttcttttagaaggaaatgttgaaaatatctagtagataataaagtacagaaatataaaatatagcctttaattgaaggatgcaagaaaaacagtcgctaagatactttctaggtctaatattataggatcaatctcttctgatctcatagtatttatttcttcttcctataggatattaattgctttttcatctatggatcagttctaatttctaatataatgcacgattgaatgagctccctcctcttctgtactcaggaggccgacaccaatggttctgtggctcaattgctttttaatcgatccctctgaagagtcagtatgttagcagaatggcaaaatatctcagagcctgcacacctgtctacaaagttaaatcagtcctcccctttctctagaagggatgggtaataggaaaagtgttcatcccaggaaggaagtctatgtcataattgcttacctcatctaaaatgcagctccagttcaatatttttcttgaagggttgctgtgaggacaaataagaaaacagatgtgaaatgcccagcagagttgagtcagccctcaataaatggtggctatagagcagcagaggtggccgtggtgatgttgggggtacattttaagctgttagtacttttgtgaatcaatgaaagtcaatgagtctttggtttatgacagttactttgccataaataagatggttattcacctgtgctttgcaaaagaagtccaagaagggctgacaacttaataagcaaacttgacaactacctaggacatttgttttaaatgatttcctatttgatacatttcaaaaaaaataattaaaatacaattatgttaggtttcctaacatggactttacattttggaattggttttattttgagtaatgaatagatgactattatccttttagtttttagtttctctacaggccttagtcctaataaagtttttcatttgcattgaaaaacatgattaatatgcattgatattcaattaaatgggttattgacatccattttagaaattctgttattttaaaagagaatagggatcagaagcaatacctctcttccttcaaaaaatgactgaaaccagcaactttaagactgccatctaatagaggttggatagacattcctctaggtagtaggatggcttcgtcccaaaaagaaaagtcttggtcttatgttttacaaaacttgtcttccatataaacttatatgtgtaaaatatataaatatcaatgattcatgccaattctattgaataggctttttctaaatttgtattgggtcataaattgccttgaaaaattcatataagatgtgcaacttttctgagtaaaatgaatattaaatgtctgcacaaaattttgcatattttttctagagattgttggaattcttgaatcctattctggtaggtagtaggtagaatttcagatttaacaccgcaattcaatgaacttgagttggaaggataatctacgtggtgagattaattttataataagtcttttgaagtacagagaattaaagttattcagctacctttgtcagggcaatcaacctagttcttaatttctactctatcaatttctctctttatttccttgctgcatccagagtgatttaatttcataattggcaaagtctgtacaatgttttctttgttaaacacttctgttcataattcttattgtttcttaattttcctaatatttctgtcattttagtttattttctacatttgaccctttttctcaacaaagtagtaagatcacttggacaaaaaataatgtgtaaatgggaaaacccttagaaaaagttgagagagaaagagaatgatagtttatataattccaagtgttacctttacgtcatgatcattaaatagttgatgtatttttttttggtcaattggataaactagacataaaatttatgcctcatgaatgatttaagtttgttttccaacagtggggcattccaacttaggtttgaatttcacatccaaataaaagcagaaatttcatctgtcatcgcacattttggctttgctgaggggaagacccagatgctatgtggagagacatgtggcctggggacgagtaaacagccactacatgattgatgaacaggagcagttcacacagtttctgttaagacagggagctacatctcctcagaccattatgagctatcaagtctgggctgactgagaaataagttctgtcttatttcttttttctttttttttcgagtcggagtctcgctgtgttgccaggctggagtgcagtggtgcgatcttggctcactgcaacccccgcctcctgggttcaagcaattctgcctcagcctcctgagtagctgggattacaggcgtgtgccaccacgcccagctagtttttgtatttttagtagagacgaagtttcaccatgttggccaggatggtcttgtttccttgaccttgtgatccgcccgcctcggcctcccaaagtgctggcattacaggcgtgagccactgcgcccggccaaatattagctattcttatttttaagtttctgataaagaaaaatgttttcccatgattttacagttctcctgcatgctaactaggattttaaggaattattatcaataatatatttatttatttattcagcaaatatttttgaaggctcacagtgtatcaggcactgctgtcgatcttgggcaaatagtagtgaataaaacatagtgactggaatgaggctgagaggataaagaagtatgtgagcagaggcctaaagtaatgaaagtgaagggaagcacgttccaggcaagggatctttagatgtaggaagggcccaagctggatcgtgcctggcatgtttaaggcaccacaaggaggctggtgatgtagtagtaggaatgtcacgtcaggagatgaaattggagtggggtggagtcttcatgtcagccctaacaggcaggaccaagggaagccattggatggggttaagcaggagcgtggcatatctgatttacattttcagaagcatcattatggctcctttgtggagactggggtgacaagtgtgaaatcaggaaggccaattagaagctattgcagcggtttaagtgagacatgatgctgtcctggactagccaggaaatgtaaaaaacaacacaaaaggcctgatagtattctgaacatgacccagatgcctgacatgaatttactgtaatccatacaacagcctgaaacaggatgtattattaccattttgaggtatgatttaccgaatgtcattgcatctaaagtgcaaggatgccctgatgctctctgtctttcctgctttctacagccaaaagtaaaagagaaaagaaaattacctgtatgtcaatcgctttgctaggataagtaaacttatgacttttaaaataatatatagtatgtttaatttcaaccctagtggataccttggggaaacaaattttaagactggcagattgagaagaatggaaaattgtatagcacgttttggaggttttatgttttggaatccaatgctttggaagtacaaaacttcttttagaacaagattaaagtaatttagcattttaagataaaacattagaagcaaagtactggctgagcgcggtggctcaggcctataatcccagcactttgggaggctaaggtgggtgaatcacttgaggtcaggagttcgagaccagcctggccaacatgttgaaaccctgtctctactaaaaatacaaaaaaattagctgggtgtggtgacatgtgcctgtaatcccagttactgagggaggagaatcccttgaacccaggaggcagagttgcggtgagccaagatcatgccactgcactccagcctgggcaatagagtgaaactacatctcaaacaaacaaacaaacaaacaaaaaaaaaaaaagaaagaaagaaaaaataaagctaaagatataatattctggaaaaaaaactaattttgattttatttggatattcattcattcaagaaacaattattataattatttagtacctagtatgtggtaggtactatattacatgcttgggataaaaaaaatgaataagaaaagaaaagattcctgccctcaagagctcagctttataataaattataatagcccatgttaaaggaaaaaaaagtgttgtattagaaagtcaaaagcagtaggcagttatgtgtcttgaggatggcagggaagtcttcgaagaggagaaagcattcgtgatagctcttctgttacaattaggaagttcatttgatccatggagtagaacaaccttcattcatttgctcccaatactcttggtcttaagaagactttcctgtggctcaagctagaaacaggacaagctagttttgtttgtcctgagtctccttgtattctaatagcatagagtatggaaaaccatatgactgcagttacaggtaagtatgtaatatggctatagtcttgtatagttctttctggctgccccggtctcaactgactgtggatcagatcagcttctgggcattttatcctagaaattccttctcagaagtctcatttctggctgaacatcatctaaatccctgccatacagtagtaactcttcttggggcttccactttctactgtcttcactttgaacagcatgtttgggctgtttatttggattctgtgagcaacagatgtattctctttgcctcctgcagaaaccccattttgcttatttttttcttttaacaatattctgctgtcacctaaaagaatgtgacctacttttaattagggctagtgtttcttacaaactggtaaaaacctttggtattatatagattaaaaggaagctctttttttttttcatttttatttaagcggatagactagtcacaaaagctgctcagttttcagactgagtttttttcttcatgtcaaaatcatcattacttacccaaaaagaaatattatagaaaatattttattacttatcttgaaatcattttaatatgctatctgaattcgtagtgttttttttttttttggtaacagtgaactgattttttttcttctttgagatggagtctcactctgttgcccaggctggagtgcagtagtgggatcttggctcactgcaacctccatctccctggttcaagcgattctcctgcctcagcctctgagtagctgggattataggcaactgccatcacgccggctatttttttgtatttttaatagagatgggatttcaccatgttggccaggctggtctcaaattcctgacctcaagtgatccacccatctcggtctctttaagtgccagaattacaggcctgagccaccgcccccggctgaggttggaaatctaaagccaggtcatagctcaatcggaattagagaatctactgtagaaaatgtgtttggagtgagtcttatgtgtaatattcagtcctgagtcatcatatttttttgatatgtgtataatgcaagagtgtttaaaaatttttctctattaaaacactgtaacacagttcgcaaaagtgtggtccaaggacattgaggagtacccaaaaccctttcagtggatcggcagagtacaaatcatgcatgtgtgtagaatatacactccatgtgtaagatagaccactgtgctttaatgtaacaaagaatgaaaagtttattgatcggatttaagattccacattgcacaaaaccttaaaaactttaacaaacttttctgggctgggcacagtgcctcacacctgtaatctcagcactttgggaacccaaggtgggcagatcatgcgaggtcaggagtttgagaccagtctggccaacatcgtgaaaccctgtctctactaaaaatacaaatagccgggcatggtggcacgcgcctatagtcccagctactctggaggctgaggcatgagaatcgctttaacctgtgtggtggaggttgcagtgagccaagatcttgccactacactgcagcatcggtgacagagtgagattccatctcaaaaaaaaaaaaaaagaaaaaagaaagaaagaaacttttctgtttctcgagttttattgtagcatcacaaaagattttccagcactatctgcaatggctattaaaatatttatttgttttcaaactatagctctctgccactcatcttattttaaaactccagttatttttccttaaaatatattattactcatatgagggggttatttttattaaatgatttataaatagtaaattcaaaatttctcagtttaatttctaatacagtaaataatactagctataagtcacatacacaaaagctttttgggtcctcagtaatttttgagaatgtaaaagagtcatgagaccaaaacatttgagaaatgctggtggaacaaaattgtcatctataacataaagatgtgctttgacttcaaccaaacacagtaaagatccacctaaacccaagcagcgaatttcttaaagtagatttacattgatatttgaatataactcctgcatcttgtggatttaaaaaaaataattaccgtcaatctattgatttccatcagacctacataattaagttctcaaaagtatcttattttcagattattttttgtattgattgacaacaatgcctgaacattttcgtagatgttaacagatattgacatgtttaaagatttgctgcgtgccctctgttttgaagtggaaaccaagtatcactatttctaattttatgcagttttttattaatgcctgtgacttctgctgttgtcaaaagctatactttctatttttaatggaaaaaaacagtgaatctacaataatctttgtatcatgcaaaagggaaataataattttataaagattctaagtataaaatccgttgaaaacctgtaggtgtttttctaactctcaaatatttttcatgaatatgctgttctttggtaggtacctgtaactactgatatttaaatgttgttctcatcagaataagataaaactaaatcataaggcatagatgagaaatgtgcttagatatttcataattaaatgtaattgaaatttgagtcaagcttgtaatttttgtttaagcatgtataaatttaaagttattttaactattatgacagttttctagtttattaaacttttcagaaagctgagactaggtctttgctcttcaaagaaaatgacattcctttgaaaatctttctaaaatggttaaaacacaacttaatgtcacctagaattagactacaattctttgtttataaataaatacaatagataatggatagccttttaattcttatatattaaatgtcacacataaacagcaaaaattcttaagttaatgattttttgttaatattggaaacagaaatgtagatgtggaatggatcatgatgtcttcatttaagtgatacagaaattgaaaaaaaattatgtagaaccaattatgcttatttccaagtttagaaaatatgtaaaataattttatgcagtatgctatattgttgtgtgattgtcaataatacaaactatcaaattatttcctactaagtagcagagatttgacctgtgccacttttttctgcatgaattcagattgtataggtctcaaggcattgcaatcccaaagacttttaatgcattttagacaagtgtttattaggtagctacctcagaccattgtaaattccttaggctataccactgtacaagtgaattaattttaataacatctttttgataaatttttataattcacaattaatacttgcatcacagaatatagaaaagaagctgccttttaaatggaggatcccatgaagaccatttaggcaaaacttagccacatatgctcatttctcttaaatataggctaatatttttattttgataatatagaaatatttaaaaattaatgaaaatacataactatttgatattttaattaatgcatgagtagatagatcagtgtgttttaatgtaataaaggaataaagtttattgatagagtttaagattccacattgcactaaactttacaagctttaagaaacttctatttcttgagttttagtatagtatcacaacacacaacttatgttgtggctattcctcagctgctacagagaaaagaaatttttagtcaatattagaagttagatcactcatcttggttctgtacttccttcctggtaattaatcaatttataactttaaaaaaatctacaaatatgtggtgtagacaagttctacactcctattttatagtaaggtgtcattatttttaccaggacatattatcaaatagaaaacaatctggaataaagtctgcaaatcactttgctgtttcctaagagaagctgtgttttcaggcttactgcttcttggtctggagggaaactgtcttcattgattctaggctcactgcttaccagttgtctgaacttgaataagagagcgagcctccttatgtacctgttttcctacatcttaagtgagaataaaaatagtgtctgcctgaaagcgttttcctgagagttaaataataaataatgtagtcggccggacacggtggcttacacctgtaatcccagcactttgggaggctgaggcgggtggatcacgaggtcaggagatcgagaccatcctgtccaacacggtgaaaccacgtctctactaaaaatacaaaagattagccgggcgtggtggtgggtgcctgtagtcccagctactcaggaggctgaggcaggagaatggcatgaacccgggaggcggagcttgcagtgagcagagatcgcaccactgcactccagcctgagcgacagggcgagactccctctcaaaaaaataaaaatataaataaataaataaataaataaataatgtagtcttggtgaagccctacatagtgcctcccacattaaaaaaaaaaaatttcagtacatgtaggtaggtcactgatgatgatggtgacagaatgatgaaaaactagctgaaaagtagttttcaaaatggagtattagtggtatattttacccctgaaactattctgaattttaataaccttaaatttatttttgtttttattttaaattaagttagacctataccaattatgatgataaagattgtgtgtgtgtgtgtgtgtgtgtgtgtgtgaaactgtgccatgaatgttgatagatcttcagtttttggcaacagtataatgactgctgtataactgctgaaattatagttctacttgacattttctatttctctttcattaaaaaaaaactttttagttgactttggaaatggattgaatttatttggacatagccgtgaaatttctttatatcctaaagacatagtcgttttcctgatatatatatatatatatatatatatatatatgtatgtgtgtgtgtgtatatgtgtgtatatatatattttttttttaaaaaggcaggatgcaacagacatcaatgtaacacgaagtaaaacatcttattttctgtttatctttattagttgattgtcctcttttaaatcttacagcttcaggatactgtcaccttgtgtgtatgacttgcaattaattcaaagtatattgttttaagggtccaggaaaaaggtgcttgagagaaacaaattaaaaatttactcacaagcttggtcagtcagaaagatgatactaataaaaagatcctgagcttctgtcgttaatggagttggtcaaagacattatgaaaataaaggaaacagcaccttataaatttggcaactatacattaattctccactggtttgacataaaaagaatgacatataatgtaattaaaaacatcttcaacactgtatctgtagaaaatataattattggaggattaaccagctttctttttttttttttttttggatttaggcttaacagcaatttgaagatcaagtttagaatgtatagctatttttttgacagatatatttactttttttaaaaaaaaatttatggatgtttctttgctatctaggacgttctgtccttttggtctttcctcttggattcattgtgctttagctacttgattttgctaggcgtcttggtctttggatagctgaaatgcttgacaaaatggaacccttcttaggagcaaactatctcattatggtgatgctttaagcttcagaatgcttcagaaaaaagaataaatcagcagtttgatttttgaaaaaaggaaagtttggagtagttataataaaatatctcatgaatatgtagcaaaccaaattgattttgataaactgcttcatattctattgtcattactctgtccagaaagatttgctttgtgtggtgagaaagttaaacagtataatgaatatttgaaaacagaaagaggagtgaatgtcaggtgaataaaaacaatttccagaacagaattttaatgcaacagtgctttgcaaagtcatgcctttgttctatacaagaaaatagtttgctaatctttgttttggtgggctctaatttctagtttcttatgagctctccattggattgttttaggcttgggaacttctcaaattgatgctgaactgacataccacttgtgaaaaattatttctaccacaggcttataagatgcatttttttccattgagttgactatttacaagtctctgtataaagaaacaagagccatggttttgtaattagacaatatggccaagaaatctgtgataaagtgacagagtaaactgagcagaaagatctcagttagaggcaaaatgatttttgactagttaagattattttctgaggcacaattaagatttattttgtgtctttttttcatgtcaaattgaattggattctgggaaatatttttcttgcatagagttttctatggcatatcagaataaatgcatctcagtataaaaacaagatgcaaaaatactggtagaactaatttgaaaaacattcttttgggtaaagcaaattctgaattttagtgatttaagaaaataattcctgtcaaggagattttggcataaaagaagaaatcacggtcaataagaaatatgaaacaattaaaagactatggcattgaattttaaagaagtattaattaaaattattttaaatgcttaatatattagaacatgataaataaagtgtaacaggaaaaatttaaaaaatagttataaaagaactcatacatgacctacattagagcttaattatattatatattaggtaatatttattgctaaatcatatttcaagtttctaagaaatcatatttattttcatggaatggtttatttggagtgaaattacaagatttcttgcttgctattatgtttctgatactgttactgaaacaccctgcggtttggtctgcgttctgctgtttactgcacagaaagccaatgactgagacaacaagtattgccaaggaagaaggctttaatctgatgctgcagccaaggggatgggagttcagcttcaaacctatctccctgactaataagactagggttttgtatagcagggaagaaatgaaccaatatgtaagaaaacaggaataatggagggccaaggaagaaattatgatgaatgagcggtctgtcttgtctgggtgtggtatctggtgagtttcatttctttcatcatttttttggagaggcctgaagttcctttcctgaggaagaaactcatgtaagacaaatgtaaatttcaagctttaagaccaggagggtcaatttctctgtttagccaaaaactctctatgggactattgggttggtttcaacatatggctaaatgctttcattaaactttatttgaattaattgttctttgagatgctgacttaaatgatatttctttttgttaatgtctcaccaaaaggaagagactgttgataaagctgaaatgatgaattatattatttagattacttcataatagtttaactttttggaggtttgtaaattatttttggtcacaagacttatcaggaaatgaagagttaattgattttcttgatatttaacttgctacaagtaataattttgatacattgtaaacagaatccattgtatgtatggattggctgcagtcatttacaatgctttttattttaaatggatgtgttaactatgcccattattttaagttatagagtattttttctgatttctgatgatatagttttattccagacttccataacttccaagttggatattgtgtgctatgttgctcactcagaaccttctttgaggattgaggtccttactttcccagctgctgggatttttaacagttgatggtctcaagccaaaaagaaaaaaaaaaaaagccaccttgcgcatgggcttgctccttccccgaaggaaacttgcaccaaatgactggttaatgagagggtacaatacagcatgaaataggcatcttaactattgaattgtatcatacatagaagagcactatctcaccaactgaggaagggttgtaatagattaagaaaggctttctcggaagaggtaggtaagtttacttttcaaatgtgagtaggaatttttccagtgttgcaatggactgaattcttacacccctgaaaaattcacatgttgaaatcctaatccccaaggtgatggtattaaagagtggggcctttgggagtagattaggtcatgagggtagagtcctggctactgggattagtaatcttataaaagaaaccccagaaagctggctagtcccttcaaccatgtggggacacagcaggaagtcaccatctatgaaccagaaagcatgccctctccagacactgaatctcctggtgcattgatcttggacttcccagcctccagaactgtgagaaatacatttctgttgcttaaaagctacccagtttgtggtattttgttatagtagcctgagtagatgaagacaggtggaaaaggggtaagcagggaattccaggtacacagaacagtgtaggatattttgaggctaaaaaaaagcctgagtctgtacacagctgccagaatttcagcgtgacaagtcagccaggtgccagcagagattgacaaaagatgaggacagaagagtaaacaatggtcagaaaattaaaattcttacattcaacatagagaaagtgtactttgcctgtaagcaggagagtggcataatcaaatttgtattttaggtgtgcattattctattatttaattgaaagcaggttttgttttagtttttggcttttagtgagcttgcatttcaaatctagtgggtgttttgtagcaagaaaaagtacagccttatagaagtacaaacaggtgaggaaggagagctgagtttcttctgttttacttggaagtgttatgaccttgtctgaccttagatatatcagccttaagaatatacccaagggatcctgtactctgccagcctcaacaagactagctcctcaagaggttgtctctctttttgtttgtgtgtgtgtaaatattttttaaagacttacttgcagtttatcatattatatagttgtctttttgaaaaacactctagaatattacttaagaaccaggatattgggccaggtgcagtggctcatgcctgtaatcccagcattttgggaggccaaggtgggtggatcacctgagatcaggaattggagaccagcctggtcaacatggtgaaaccccgtctctactaaaaatacaaaaaattagcagggcgtggtgtgggcaccagtaatcccagctacccaggaggctgacacaggagaattgtgtgaacctgggaggcagagattgcagtgagctgagatcgcaccattgcactccagcctgggtgacagagtgagactccatctcagaaaaaaaaaaaaagaactaggatattgtacctagacttcttgtcttcccaaatccaccacatacttgctctgaaaccttaaatctatcaaggcaatacttgtttcatcatttatgaggataataatggcatattataccagcatatttcagtcccatgtgacataaataaaagttatgtttcaataaaaaatgtattgtaacataaactgaattgtgccagttcagacaaagtctaaagggcaaatggcttcagccatgactgcatccatatctgctcaaatgacataaaatgcatccatatctgctcacatgaaccttgactctgctattctctgtgaaagttttattcccaggctgaatttccccatgttgaataaaagatagcacatagtaactataggcttatgttctacaaatttatctactgcaaggaaaaaatgaaatacttcttgtcaatgattgagtataagtcttggattgagtcttaacattgccccttgtaggattgctagataaaattcaatgcatcaattatatttgaatttcagataaacaatgaatcattttgtaaacaaagtgtgacctaaacattgcatggaatacacttaacctaaaaaatgattcattttatgtctgaaattcaaattgaattaggtatcccatatttttaattgctagatctggcaacctttattgggccccttgattattcttatatccatcatttggatcaagatgatagagtgttgattagtcctggttatatgccttctggctaaattctcctgccctggtctaatattcagaatctataagggacttagaaagcaaaaagcaaataagcctattaaaaaatgggcaaagggcatgaacagacacttcccaaaagaagatatacacgtggtcaacaagcatataacaatgctcaacatcactaataatcagaaatgcaaacaaaaccacgatgaggtaccctctcataccagtcagaatggatgctattaaaaattaaacaaaacaaaacaaaacaaaacaaaacaaaaacaggtgtttggtgaggttgcagagaaagggaacgtttatgtactgccagtgggaatgtaaattagttcagccattgtggaaagtagtttggagatttctcaaggaaattaaaacaaaactaccatttgaccaagcagtctcattactgggtatacaaccaaaggaaaataaatcattctggccaaaaaacacatgcacttgtatgtttattgtggtgctattcacaattgcaaagacatggaatcaacctaggtgcccatcaacagtagattagaaagagaaaatgtggtaaatctacaccatgaaatacttcacagccataaaaaagaacaacatcatgtccttggcagcaacacagatgcagctggcagccattatcctaagtgaattaatgtaggaacagaaaaccaaatgctgcatgttctcatttataagtgggagctgaacattgtgtacacatggacacaaagcggggataatagacataggggcttacttaagggtggagggtgggggaagggtgagggtcaaaaagctaccaattgggtagtgtgctcactacctggtagacaaaatcatttgtacaccaaacccccgcaacatgtaatttacccatgtaacaaacctgcacatgtgcccctggacctaaaataatatttgaaaaagaaaaaaagaacttttattaaaaagaatccccctgtcccaagggaaattgattgagagtgttctagaaggagcctcaccataaaaattgaggtgctattatcaaagaagagatactgtgcagatagaaaatgaaaacatataaacaataatgttttatataaataggtctacttatagcacgtctgtgaagattacatcatatgggaaaatccttttaaagctcttaacacagtgcctagcacataaaaaacctcaggtatttttttctactgcatatattattactgttctagtcctaacatattaagcagttaacccattcattaaacaaacatgagttgagcatttctatattatttcataagtttcttgttttcaaatttaatagaaaaaagggaaacaacaggagaatggtgaggtaattctttgttgaacatgtttgtgcattagacgtttccccttacctaactggagttgttcctaggaacagagagaaattactagctcagaaggcatgaatgttttgaaatcccttgatacttatgctgaactaacagacacttctgcaaaaatccatgttccaaatgaaggagtctggttgtctcccttttacccagacacagtgcaatttccagtaacctctgaagagcctgcacacacccatccaataatctaaaactttatctctaagtcccagctcatatgaccccttactgctgaagtcacagatcaaggttaacaattactggttatagttctctggcatgggagacagtctgaactcccacctcctagctgaaatccaatccaagagacctgaagagtcaatattgttaccgtttttccagagatgtttattccttcgaaagtgacattttccaatacattcataacatatcagaccaataaatagagtaaatgaggcatacttcaaataagattagaattagtttcaaactattacaaattcagcataattttaaggagaactgttttgaactaatcttaataaataaaacaatgaacttattattaattaccctcaattcatttattcaacaaatacttctatagtgcaagccatttgccaggcactaatgttggggaccataattttatcaataatagcctctgtgaaaaatatagcttttatatttaagttgagaaaatttgactaacttgactactgacctccacaaagaattctggtacatagtgacatttgctttattgttagcagttctttttaattttttaaatctaagtttaacatgatgatttaagtttcacacttagattggggatggttttaggttgtgttataaatgtgggtctgaaagtaccaaaaatatacttcagtttgttaatttttagaaacaaagaggcaagatttatttgattcacacagcgcaaaaatgtggcaccggctatgtaggggaacaatttggcaaaaataaaatatttcacaacctccattatttcagaaaaatgcgtgtttttgtttctttggttataagaaaaaattagagatagaacttccctggcatatatacaaaaacaagctcattagtgttggaatctatcttcttataactgttgggaacaaggaaagaaaaaccaatctgtttgttccctattttatattcatggggctgcttatgaggcggtttgattgacaccgttggtatatgttgtctgctttctttagatcaagctgggggcttcggttcacctatcactcacttccactttgctaccaaggtctattgtggctctcttttcactctctaaattgtgttgtgatgaattgcacacttgggaattcttaggacatcttaatcccagtctgacataaatcccttcaataaataatctaccaacccctatgccaaatgcaagtggatcagtggacatagatgtatgacggctttcacagaatgaataagtagaagtgaagagtttgctactgcactgagactccatgaatggtctccatttcccagtttaatttcccccagacatatttggttgaaatgtactctgcaggttttattttaaaaagctctctgtgtgtatgtttgcatgagacgctgtgagtgtagatgtgtgtgaattggaatgtgtatgaatctggaattgcttcattgatgtaaaatatgggaaattatatttgtaaggcaatcactggaaatcatttttatatataagctgagcttttctttttaaaatcaattaacttcaattgacaaataaaaattgtatatatctgttatgtacctattatttagaaatatgtaaacattgtagaatggctaaatcaagctagttaagatatgtattacctcacatatcattcatttatggtgagaacacaaaatgtactctcttagcagttttcaaaaatacagtacattgttaactatagtcaccatgttgtacaatgcaactcttgaacttattcctccatactaaaacgttgtgtactggggcttttcttggataaatataaactgataaaatttgataatgataatgaatgcttataaatctgataaagtaaagatatttctaaaaccattttcagtactttttaacaagagttacagaagcaaatttaaggggaattatatgaatagtagatttagaatatgaataatgtcactcatcttaagtgatttatttttgtttaaaaacacattgggaagttacctgtgtagttgttaatctaattataattttatatttgatttcaggctatttgaatatagcctctgtgatgcagaaatagcaacaaacatatttggtaaattgaacaatcagcctgaatattttttaatgtaaattctatagctttctgacaaactattaatgatatcaagtcgttaatgctatgaaataagagttcctgtagaaaatagaacctaagtactatcgttaatgtatattatttacatacatatatttatacatacacttatataatgcatatttattaaacatttaaaaggtaaaaaacaattttaaggatcaaatctaaatttgagtcattttcagtaattcttgcaatatcatgcattgcactgtgaattctgtcactatattatagaagcaccattctttgtataaagtgacagccaccttttctcacccttaaggtatatggcacaagttcacagcaagtcagaatgtgatatgttgctatttgccattaaaagttagacagctttataagcctcttaggagagcaagcaatgatctttcaacttcagtaatgaagaaatgggagggttttgtataccctctatagcaatatactgtgcatgtttttcaatatatatgtgtttagaaatattgaaaacaaatctatggaatgggaaaatctgtaatttcctaaatctatagaattaaattaaaatgggcatattgttgttgcttccacttaaacaagactgaattttttggaacaaaacctaaagaggttattaaattcctactaagtaccagcttctttttcttcacctctggagctaccagcaggtgactatgtggcctcattaaggccgtagcacagggtcaaagattaaaattgcctctgtcctgataactgaaaaaactgcagcctccaaattagtatacttgtgtccaaattaaacagtaatgcatacttttttttttttaacctcaaatcttctctaatcaaacatgaaaagtacagcataggataattgttaaatgaaacaaaatgttataatttttggatggcatttgatactttacaaagctgttttattgtgaatgtctcatttgtcccatacaatgattctgggaggtttgcaaacaattgctaagaaaaagacatattacagaagcatgaactgaggcatagagagggaatttttctaagagcacagagctactatggtaggaccatgtttactgaattcagcctgctccattctgagacctgggagcgatcatgtgctcagccaggggctgatataataccctctgacacctaccagctccccaccccaagtttttgaaaatatgtgagggtgttttgattgtcacagtgaaacctggtggcatttagtgggtggggccagggatactcccatagaagaggacttgttctgcctaaaaatcttgtaatgctcctgttgcgaacatttacaatcacctggcctaccaggaaagggagtttttgcaattttataactatgtttaaattccattcaataaatgtattccttgtttttgtttgtctttataaatgagtctaatgttatatggttaaaaaaagatgtttattctctaaagaatattatatataggatggttaaaataatacataagtttcattattgttttgttttttagttgtaacacatacacatataaacatatctatatctctcactgtatatcctgttagttgttattcttccaagttagtaatgccactattggaaaaatagtttttatcctattttaaatttgggatcctgctattatattttactaccaaaagcattggttacctcctgccattttgagacctagaaaaaagataataagcctcaggcattgctggaagaaatggaatagaaactgttcttgcaattaaatttgcatcttttatggcatatttttaatattttatctgagtgcagctaattattttgtttcctaagtatctaatttggtttactgaatgttttagcagtggtagtattgctaccatttgatgaagtaggaagtaaaatatgcatggttgttacttgttaagagttattacaattagtgtataataaatgtttgatttcatggttattatatacttagctcttttacctttctcattcatgaaagataattttaaaaactggtaaatttttaaacagtcattctgtgcaaaaatatagcctttaaacaacaacgacaaatatatatatatatttatctaccaacaactaagaagtatgatctaagtgcagttaattgattcacactgagcttgtaaatttgatttcagaaataatagttcaggatttaattcaagaaattgaaaaaagaaactcaaaacatttacattcaagtcatattttgttaagtacatattttaaagtcatgattaatagaagaatcatatacttcagaaacaaattgtcctttagagattaatgggaaacctccagataaaagcacattcttgtgtttttttctttaacttttaattaactagttaacaaaacatttttaacaaaaaaatttttaagttatatatctatcaaaatgaaaaggattagaaaaggtgtatgtaataaaaataattggagcaaatcagtttaacttggttcagtctttttaatgggaattatttcagagtgtatcactgctctgtggttacctttttaatacttcaaatggtcagcaattatgcattacatgagttgaatttatatttgtgtaatcttggaaaacgtaaatagcaaaatctactcttcaaaatgacttatactgtagaaataattggggctacagtatctgcattcttctaggatattctaataacttagactatttggattgtaaccatttttgacgggaaaatatagcaaatatgtgtgtgtgtgtattctaatttttttttaaaaaggtaatttctttattttatctgtgtcctctgtcaacaatagaaagacaacatatgttgtcctacttgttgaaacttaaaagacagggaaagagttatcagttgggaataatacttagctggaagggagtaagattcagtaggtactgcccccattactactctaataggagcagacttaatgagcaaaagattccccccaagccttcaaaatattcatttcatatgaatatataaagaaacacattgcaaatatatgattttaataattatgtgttacatatataaatctatattctttaaatcattatataaattttggggcatgtcacaccaaatatcagattccagcccaagctaaggaccaaggggagtgggtggacaagtggcaggtagctgaaagaacactcagggaatcatagggagttttgacatggctttactctttctctggatgcaagtgagcctgggcatgaacttgggtgcaagccgacctgggcataagctgcatgtacagtgtcagcagggtagttatgcctttgacagacaacagtgactccgatccaagcatgagctcacttgggtgatcacctaatgcacctcacgtggcatggttacataatgagtggagttgtgcaccagtgctccaaactcgctgagtcatgctggactggatgtctgccttggcctattcttgaccacagcatatccattttccttacactccaccccctaggccaaggcagacataggccttggacacacaggtctgacacagaggccttatacataggctctgggcacacaggccctggacacacaggtccaacacataagccttatgcataggctctgggcacataggtcccagaaacacaggtttaacacataggccttacattccactccctaggctgagggagtttttctagtgaggagatgtgcccacagggtggaatcctggacccagagttcacagcagtaatacagggaacaacaactccaggttatggcaggcaaccaccccatggtgactttaccctaatgttgcttcatacattaagccaggtttttatttccctacctttaagggtgttggggcaggcagcaacaggttaccgttcatccgcatacctggttggagaaggtcatccttcctcccctaggtcttgccacatggcctggccgcatatgggcctgtgaccaactagttacttttgtaacttctaggtagttaaccacaaggctaagactcgataagctccccagctgtcggtgcaggttatcatagttgtcacctccttggtgatcaccattcacattgctctaggttcagcccattgactactttgtccacacctggtatcaaaccatatggtgtcaatactaggttggagtgcaacagcagtccaggcagcagtagcaccttggctaaacccatctgtgtactatgccccatagggaatggaggatgcccttccttaaacggtgaaggcttgaggtctaggggtgcctcaggccccatggccttatcttgcattaggactacaggtcccaagatctcttgcaactctgctgctacgggacttgtactcagcatacttggctgctccaagtaggtgccccactttgctaaagtggatgtctgtgcgtcccagtttggggggtcattttccatgaatgcatccatctgctattaggtaagttgtctgcacgatgactgtagcccatccggccatgctgtcatgagcctgaagggcagcatatgcagttactaactgcttctctgtcaatgaataatggagctcagctcctttccatagctgagaccaaaagcctactggtgttctcaagcactccatgcgctgctatagactccagccaaaaccatctgtggtcacatgcacgtgcagctcaaataggtgccctggatcaactacccgtagggcttgtgcctgctgaatagcccgtttggctgcctggaaggtggtctcagccgcaccatcataattctaggcaaggggagctttgccacttctaaatctgcaagacaatcagaggttagcatagtatcattaacaagaccatgacatatggtggggctatgctatagccctgcagcaacactgtgaaagttcattgtcgccctcccgtgaaggcaagctattcctggctctcgggaagagaaggcattggccaagtccactacacagtggtactgtcccagtactgtcaagcggtccatcaagtccacgatagatggcacagctaccaagctgtgtaaaatatttacttccagaatgtatccgtgctggtgtctaccagcaccagcactctctgtatgttggtggggtacaagtcgattgtcagctccacacgtggcctctggttgtcaggtatccctgcaagccgggcacttcagccaggtccctcatcaaacagcaaaggctttatactccctgcatggctgcagcacgtagtctttgagttgaagcacctaggggggaccgggttgcacagcaatgtccttctcccgcttgggcattttctggaagtgctgctctggggacaactgtctccacaaagttaagagtacttcattgggctgcttatttattttctctctgtcaacctggccaaaatcaaatctatccacatctgtcagcgtgtcactcattagggtcccttttctcctctgggaggacctctgaggtggcgcattttccccgtctttacagcgcggaccccttggttctgccaacagcctcctctgtatcagacctaatggggtctccgactgagacaacggacccaggcctgcattcacagcaacctctaataccttttccaagttctgtagccaggcctccaggtgcccaccagcacctggagtgcccttacctccgctgcatccctcaggggctgagtgtgtacttcttgtaccgcggtcaaaaatgcacatccaactctgccagcaaaggcttattccttcttggtgctctgtacttcagctgtttcagcgccttctccatcctcacgggggacccatctactgccgcccaggtttccactggatcccatccgagcagtaagctgccaccggccaccacaaccaatgtttcagctgcatggctgactcagaatcagtggggaccaaaggctcactctcctcagtatcctgctggctataccaagtgtcaggttccagcccaagctgaggaccgaggggagtgggtgaacgagtggtgggcagctgaaagaacacttgaggaatcgtagggaatttcgacatggctttactctttctctgggcgccagcaagtcatgggtacgcgcctgggtgcaagccgtatgtacagcgtcagcagggtagttataccttgtacatacaatagtggctccaagccaagtacgaactcacatgggtgatcacctaatgcacctcacctggcttggttatataatgagtggaattgtgtgcccgcactccaaacttgctgtgtcttgctggatcagatgtctgcctcagcctgttcttgaccgtggcccatccgttttccttacaggacagtatcattgtcttagtccaggcctcctagaagcagagcctgaaattgaatttcttgtttgttcagagggtactcaggaagaacaggtaagggaatgtgggaagccagagaaagagctaagcaagaacaagctttcagccagaacactcctttcagcctgatcccatgaggaatggttagcatgaactgcactacaaaatcagtctcacatcagtgatggttaggggttagccttttgtattcctgctagaatccatcattggctgtaggccccagggagaagaggtggggactagcgaagggtagcaaaacctctgaggagcctctgttcagctgagggtcattctttagagaaggggcagctgtaaactgtttgcagctaacactgcacctgggggaagagtgcacctgggcatgtaaaggggacctgaataatcaacattgtgcagtcaccaacattgtccaacacttagtgtcgtttttgataatccagtgtatttgctaagtggtctttgtgagcccatgatgctggccaaattatccagacacctaatgtattgtttgaagtatttttgtaagtgatactaggtacacattctaaagtgattaaaaaaatgtgactagatgcatgagaaccaaaagcagattatatgtgatacatccttactgaaattctgagatttcagtgtcactagtgagcacttctctttccttaaatcattaaccttccttttctaacaccctcaacttctccttggttgtgcttagcacacaggcttgcttgctatgtcttttccttagtgcaaataagatctgtcgagctactgctgtcacaaacacctcttccaataccctacctggtatctagtggtatcacatctattatttgttgagcaaatgaacaagaggtactagaaatgaatagagtcacctaacagtagatatacttgaataatcaataaacatatacactttgagattattttaaaactctgttttattaggaaccctttataaagtgcacagttctgttacccatgcataacatatatgcacacgcatgccttatcgttctccagtcataagattgcttgtctcaaaagctgcatatctcattgcctttcttgtgtaattggcttcagttagatatgttaaacagcttcacatttctaaatcactctatggtttcacacatatcatttctcctggaatgtgctttttgcatatttggtgtttagaatcttttttaggcctgagttctgtccagaatcatggaagagcttgtaaatagggtgtgttcacaaaatagcaacttgacaaaaagagtaaaatattgaaggatcaaagtaaaggattataaaaaatttcaagaaataaatgaacagaaaacacaaaaaaagagtaccatggtataaattcaaaaacatacaactaatttgcagaattcatgttccttcttcattagagagaagaaagtaattaataaggctaaattcaattgctatatttattcttttttaagatagaaatatcctttttaagtaaaaatatatgcgtattactgaaaagacaatagagaatgctttaaaacccaaaataaaaagatctcattattttattcacaggtatatttcaattaatattatgatgcatgagtatacattttataaatatgtatgtgaatgttatatatttatatatgtgatatatttatttacactaaaaattctgttggataaccttgcttttttgctaaacaatatattctacttgagtcgctaagagtattaaacagatatcaataatttctataccatattttgctgcaggctttgttatacatacgtatatgtgtgtttgcacacatatttagagatttttgtgtatcaagggaaaaattatagtttatctccaacccaggaaaatgctattccaatttctgtcctataggtgtgtttttcctattcttgtacttcataaaatggaaccatgcagtatgtattccttttgtatctgtcttctttcacaatgcatcatacttttgagattcatttgtgtgttttgtgtgtggcaagaatttcttcttttttattgatgagtagtagtccataatatgaatatactacaatttgtttatccattctcgtaatgatgtaccttcatgtttctcatttttttggtattataaatagcagtgaaacttctcctgtatgtctctttttatggacatatgcttttactttgctggaatgaggaggttatatatctatgagtagaattgctagattataagtgagaatatgtataacttcataagaaactgccaaagaagaaaactcaatttgaagatattttttggctgaaaaaagttaatcaatttctaatttctctctgctaatgtaaatagggttaaagatgaagtgttcagaagcaattagaatctttgtttctgtatactgaaataactcatataaagttctcccacaaagccagcatagtttattaaagaataaaagcttttaagatgaattactgcaaaacattttttacgtgttttggagcccccaaatctgtgttcatttatgatgaaacaaattgaattactataatagttaacattcgttgtaataaaatccactaaggcattttcttttcattaatatttctaaaatatatctttttctgctcttattgtgagcctttgtaacacaacaaatattaagattatgctcacaaactgaacacacatagaatcgtcaatatgtaattaactcagtaatgcaaataaattaataggtaaatacaggccagtgaaagcaaagtaaatatgtgaaaataaaagtatgtaaataaaactttactctttgaacaagtggatattacaagagacacaatgcctgtgattattacagctataaactagaatcataagtgtctgggaggaaaggtgtcagcatcttggctattccataaagacagaggcaggggaaatccaaattcttccttgtaaatgtgagaaaatgagaatacacaattataaccccaatatggagcattaagtgaaactcttcacaaagccaaaatgtcttaacgatggggtgtatatacttatgggtaattcaaacctgcaaaaactgtgtcacattagtttttaataaaaaggaaggtcacaaactctcgctttaactggagcagcatagtattaatagagtagaggattaaggttttattaggtttcctatccataagccctttgctttctttgatgggaattccagaaagcaagggtatccacttaaaaaaaaaaaaaaaagttccagatatctctttgtgtttgaatgtaaaatagaaggggcccacttgttttcctattcttaaaccaagttagatagcaacctaggtccattaaaagtgctgcgtaaaaactggtgcctgacttctaccctcagacattctgaattaagtgatgtgggatcccagcatggtatcacgatgttaatatttggaaactctcttagtctttctaacatgcagcaaagaaatcactgccttcgagccctgtagctcacaaggctccatgagtccattttgcaggtggtaaataatgagactcagagagaggggaaagaatttgcccagactcagcacagattaattctagccaagccaaaataggagcatagtactttgtgctccagtaacttattcctcccatcctactgcttctctaggtttttaactaagtttcctcatttgtaaaatatgggccttaatagcacctactgataggattgttgtgctgatcaaatattatgtctgtagagtgctgagcacagtgcctggtttacagcaaataacatctatttattgttgtttttgttttatactgggggtatagaaatgaatggcattctcctgggaccatgagctcattcaagtcagggactgggattcctctctctgtacctggaattcaggaaagatcctgacatttaatacaagtatttttcaatgtggaaaatgtgttgcatatattttgcctttattccaggtagacatatgtgtgtgtgtgtgcataatgtcatatatatgcacatttcccataaatataactgatgggatagcaagataagatataattaaaacacatggtagtgtgtgtgtgtgtgtttgtatagtttaaaaaagacattagaaggagaaaatatatgcttaattttcttcttggaaatgttattttcatgcatattatgttaaaagtaattgtagctgaatgtttaattcttctgaaaactggtaacttgtctgtgtcgtccctgaggcacatgccacgtaacaacagaatttatggagaatgaccaggattatcaaagccttgttatttctttagtgcttgtgacacatcacactgcattaaaagtgatttctaccatacaacaaaaagaccatttgtaattcatttctcagccccatatactagaaaattatatgcctgtcaattctagtttttgtggtataatgccttacatttatgttatgatttatagttacaaagttgtagcacatacatgattttaaacatttctaataatcttgaattagaaaaatcagtttattttggaaatgtattctggagtgcttaaaacatcagatgtattattcagagaaccgctgatagggtgaaatgtaaaatttcctgttcctattcatctcataaattttccttaaaccttaggttttgtttctgaatactcttatataatatattctgtcacaataacaatgttcctaattaagtaatctttagtaaagattaatttttctataaattttcatatccaacgatgtaaccttggagacacattttcttctctgtgtcaaaacaattaaggcatttatttgatagcaacatgcttaaactagccacaatttttcactgattcttattattcagtactttgactttaaaaaaattacatgagaaaaggatacttttcctcagaaaattgaagagtgtaaaatctatttattcttagataattcccttgctcaattccccaaagaagtgtattatttcaaatttgtattacttttctcccactctaccatatcctctttcattttaaggcaaccatcctctattcacatatataaaaaaaaaaaatgtaccagatgagaactacctcagtttctttgcccagactattctcatcctgaatcgtctttatctatctctcttatttctgacaaatataaatcggagtctattttgttcaagtctaacaatcttctcttgttatttcagtctttttccttactctctaatgactttgctcccctccatcaactgtccctgttttctcttgtgcttcctctaaggcaaacaaatctacaaacagaccaactaaaacaacaagctccaagcctaaatcatctcaattctccttccttagtatttcttgaatctttttccacagcaccattcctaatggcactagttagatctgtgatcctgtcgttttctccctactgtagcaatgcagtagctatccaacaggaatccccacctcaggtgtgtccagctagtctgccttttcaagcatcccccatagaattcttctagcattgtctttatgacaaaatccaaacctcatagtgtagtaaactggttgttaacatggcactcttcctgtctggaaattttggctaggccccaaagctagtggttatgaatgccaaacatccttactttaaagagagttattagaccatgtatatggacttgcaaaatggttccaaaatctagttctaaccttagctaatcttctactttgaagctatgtaataaaaagcaaagaggatagttggttggctgtgggtagggggatcaagatgtctccaaccaaaagaggtggttgtaaattagtagaatccagattttatggacaggctcactgagtagctggggaaggaatcacaattgctcagtgactacatttagataaccccaaagtgggaatttctgcagaactgcaaaagctttccaggagacagtcagcactagaatttctctacacccacccactgcaaagtgtaactctctgcagctgagttaagaccctttctgccattatctatcctccctcctctgatccagtcattaagagttgcaaaagtgtgggatggtagtcacagagctatgactctgtggtgcagattattctgtgaacttctcagggtgagccaggccaagctgtgaaagggttgaaaggtttcaatttggtagagattttgttaggccagagggtttttttttttttaaatacatgaaattgattaggaaattatagactctgggagagataacatgttgggttagagacaggagatttcacctggcaaagaagaaaggcaatttatttgtccctacaatattctacagacctaaaaacaaaaatccagttctaatagtaagcacgatctttaaacagaatatttgtttcctatttaactaccctcatctttcaccactatccctccaatctccaatctgtgctgtatcaatatactttggacctccttccttcatcaccaaaggtgattcctgaatctttatttggaatcaccttttcaatggaaccttccctaataccatatcccaccccattttacatgaagtgttaccttatgtgttctacggcacaccactcacttccatcccatcacgcatcaacccagatagtgatggtctcatctatttcccttatgagactgttctataatctagggactctcttttaaatctgtatccctggtactaattgcagtgtcattaacagagtataggttaaataattttgtaaacaaaaattaattggtaatggaatcattgagttgagataaaatataaatctgaaaagatactttaagtatatgtcactagaaagagaaacagaattgcacatgaaacattttctgtaaaagataaaagagtgcaacttaaagtgctgtctgtgcctattacgattatcttcatatgactacttggaatctcagtctctgtctctatctcccccgccccccattcttgtgctggatagatgtgaaagtacaatactgcttacctttcattatcaagtattttcacagactcttacttcattctagaatgcacttgagagttatttcttatcgtaggttttccagttcttcctcacagataattttactgttatctcttctccctgatctgacctttgccagacattgttgttactgctgccctttccccaaatctgaagatgttttcaaaattaatttttcattaaaatatatcgtaatatatataaatgtcaaatgaaaacatgatagagtattgtttgccctctcttctcattaaaacttagaatgtttcagcttggactttagtttaatagctattattcattaaaaaaagtgaagatataaagaaaagtggatgtgagatccactatgtaactacttcaactcttgcttggtatttacatatgcatactccagcatacacacaaatcattaagagaagaaacttttttgttttgttttttgccattccagcataagaaataaggacatattttgctatccctgcatgaacatgcaggagtttgtcatttttggcacaaagcaaaatgaggtttgttatcttcaagggtggggttgagacagtcaccggagctcttgagccatagcttgactaccaactggaggttgcttatgataattgataacccagccctacggagcagctgatgggagaatgattcacactctgtcactggctcatgccaactcatgtagaaatacacacagcttttagcagctactttgaaatcttactctaataaagtcatttagctttagaaatttaattcaacacaaactacttcctttaaggagattcgttaccagaacaacaatgtagccttataattttgatgccaaaattattatagtgggattccagtgcaccatgaaagcaattatacagatatgatgcttttaaaaatatgacataaagttgataaaatatgcataatagataaagggaatgttttgaaagccattatttgtaagtaaatacgttctttgattttattcagcaccacaaaatgaattttcaggttgtaaagcagctaatcaagacaaacacaaaacatatcaagtatgtaactggctactatgttaaacaaatttgttttcaataatgcctactcttcaaatactgaatttcgcttgttggggggaagataaatttcagcaaacctgcgaaacattgtaaaagtgattcggaaaaatctaaccataaaatgcaatgccttaacttttttgtactcacttcaatatagtatgcatttccatagattatggtgtgctcaagtgtaataaatgtttcatttaattatttttaaatctacttaaaaaatgagacatttcattttggttcacgcttaatctttttagacttaaatatatttccacaaacccacgcatctcaaaagatttggcaaactacaatgatagcaattattgttaattccaaaaactgctaaaatatcccagatatttgtcagtttgcccgggactattttggacacacatgatagaagctattaattttttattgtgatgttgccattagtaattttaagaagtaggtaatctgtaaatgtgcattgttcaaagtatcttcagaaaaatttcaaactgtgtctaacattaatagtatttaattatttatcgtacctgtttggccttatttacttgaattatgaggggttgaagcccgggtaaagtgcaattctcattccaaagctaactataaagcttcggctaaatccttgtacgaccccttgagaacagcacatcacttaccaatgtattttagcagaagaagcatcagacaaaggggactgggaattagaacaaatgggatctagttccagtttaactgatgctttcaagacgaccttcataaaataactttttgttttaaagaaattatgactaaaatatcattaaccatctaatattttctgtacaagtcaaggtagatggtactatgcaagataataatatattctggagcaatctcaaagtacggagatcaaatgtatagtgtttgtgtgtgtgtgtgtgtgtttagttagagttacagaagaaaagttagatgtttcaggaaaaaaaaaaaaaggaacagctgctcaggttaatagcatttgaaaatctacatagaatcaacagagagtattgcatagaagacataggattatctgccaggcagttggctcagtcaaagagagttcatttaatacttacacatcttgaattcttaatttctgttttcttcactgattctgttgatctttctactttatacacagatatttctcaaggattgacccttgattctttttacctgtctctatattcacacacacacacacacacacacacacacacacacacacacacacacacaaacacaaacacacatacacacacacacagacatatagacatatatatatatatatatatatttcccctgttttttgttaactagataacttggggcctgttctgaatgagtttctaagcatttagtatggtgatagtaatacctattaatagagttattgtgaaattacctaatacaatgcttggcactcagcactaagtgattttatgtcatatccaccttgttttcttgtttggaatcttactgaatatgaaatgacttttggacacaaagtcattctatttaggttttttttttcattttctgtttctttacattaaatttgaaagttcttgagggcaggaactgtattttcatgcctaaagttatgtatctgatagtacagagtaaggtaaagagggatagagaagagtcaaacatttttttagatgcatgaatttgtgaaaatacaactttaagaagttttccacagtatgtggtgagatttctttgcatgatagagtgcttacactcacaatagatgataataatcattctttgtatttctaagatgaatatgaaacctcattgagagaaaagcgtatctcattaagcttgtatgttacagcctatttctttgaaatatattcattaataaaataattcactttttctctttttttgatttactttattcatggtttttgatttgctgctttcaaacgtctgtttatacttgcagttgattatatgaacacatacacacgtatgcctctaacaagagaggaaggaaattatttattcatgttatgactttgatttttttctttaacttttcctttgatttaaaaatatataaaacatttgtaaagtcaaagttcttcctgatagaagttaggaatgagtagaaggaaaaaccaaagattttacacggggtaattgtcaaagcaacttgcctttgtgttctttgagttataaggtggtgattaggttttcaggtttagagaagtgtgagacaacctaattaaacacctttttgctgaaaagcagctcgataaattcagattgctctgggaaattctcaaagcttttatcagaaagctaatactacaaaaatcttttaaactaatcgcttttgaaaaattatttcccagactggaaataaattatatttgaataagtaagcatgctagaattattatattgaatagatgcaaagatgtaacttaagtttaaaaaagtacaatcaataaatgtatagtaagcacgtgttttctaataatgattaaggcaaattactaattttgtgatcccttaactctttgatttctctttataaatcctgtataaataattatgtaataaggggattgtgagtttgggatgagagaaaagctaaaatctttacagattatagacgttcttgagttgtacataagacctttatcttctttatcagcatagtgtttattattgcccccattaacagtatacctattaaaagttaattgtttacctatacatatacaatggaacatattttgtaattttgtagtgtcattcaatggcattctctcccttttaagaaaaatgttttttgatggctcctgttgacttttcaaggctcaaagagaaattttctttaagtaatctagtttgtcattctgtaaaatgatagggatagatccaatgactcctaagatcccttccagtctctaacaatatatgattctatgaatttctttttttcataataccaagaggaaatggtgatggatttaaggatattgggaggatttcattattttattgaaaatggcccaaagctctatcaaaaaaaatttggtatgaaagtattacagtttgaaaaggacttggaattgcagttggatgatgggtaagggtggtgtaaacaaatccacacactactgggttgattaaatttatctttctgggaattgaatatatggtgatgtttcatattacaaatgagatttgaggaaagttaatgaagctgaatcctcattaggtagccatgctattctgcatctttgattgatagcaaagaattgctattgtcttttagtaattaatctcctttgtgccacggagcagatttttttcttaaaacaatttattcatagttaatacaattatggatatgaagcaattaaacattggctcacattcaggataaagaaaaactaattgataaactaaattcctcatgcatagaacaagagtaatgcagtcttgctgttgagatgattctttctgtggaggtgaataacaatatcattttagtgactaagattgtttactttcaattataaaactttgcttctctgactcgtaacaacccttcactaaagaggcccaaaatgacagtttctcatcattgaatactacacagttctgttgcaaacttcataacagaattgtttcaaggcaaagtagggttacctaattatttgaaatgaaaaactaattctaaatcacttatctttgaaatataagcataataacgtttgtggctcctatcatttcatttatctaatgtaaaccttttattaataacttttacaattagtttaatttttttcctaaagcaaaatcatgagtaatcttaatgcagctactttgcatttttaatctatttccagcactagcctggtaaaaaagtcagtgacaatgaatgaaagttgaaatttttcttacacaaatttttttgtccgtattcttctcccttatgtattcttttctgtgtcaagctcttttatactcttccattattccacagtattcactcctctgagtctttactcagacttgccatattcagttggtatctcttattttaaaataattcttctattctcctttgtttttaacctttgccaaaatttttcattttctagtatcttgtttatcttcaatctatgaaagatataataaattaattcatggtaaatttagtgccaagaaaatttctcatcgtgattatttccatagatatttgtatttaagagcagttttggaataggtaatgcatatttgggccaaatgagtgaatcttagatagagaaacttagagcactatcagctaaatggaaaaatttaggcacaactgcagcctgctgagtctttctagattcccacacatgagtctctattactgcttgcccactaagtaatctcatttatactgtgcttatgctttgaagaagaatggaatactacagcccaaataccattttcatcatagtgttgacattggttgcttctttaaggcctaattatttttaacttttgttttaggttcaagggtacatgtgcaggtttgttatacagataaattgcatatcatgggagtttggtgtacagataattttgccacccaagtaataagcatagcacccagtaggtactttttctatcttcaccctcctcccgccctctacactcaagtaggtcccagtgtctactgttttcttcttcatgtccatgtgtattcagtgtttagctctcacttgtaagtgagaacatgtggtatttggttttctgttcttgtgttaattcacttaggataatggcctccagctccatccaagtcactgcaaaggacatgatctcattcttttttgtagctgcgtagtattccaagatatacatgtaccacattttctttattcagtctcctgttgatggacatctaagttgattccatgtttttgctattatgaatagtgctgtgaagaacagatgcatgcatgtgtctatggtaggatgatttctattcctttgggtatatacccaaaaatcagattactgggtgtaatggtagttctttgttctaagttttttgtgaaaactccaaactgctttgcatagtggctgatataatttacattcccatcagcagtgtataagcataaaacttaactttcttcactggttatttagtagatagacattgtaccaagttcccatgatgatactttttaatattatattaccgatttatttagacagattcttgctacatcaatttagtcaacattcaatcagccaaaaaagtaaaatatgccttaaatatgactactttattattttgcttaaattatctcacctaccagatattacagtctccctgactgctaaattccttttttgcttcctaccttctttacaaatctttagtatactttggtctattttatatttctctttgtgatatttttctctgattaaatcatgctagaggctgaatgtttatgtcccccaaaattcctatgatgaaacctaatccccaaggcaatgatactagaaagtggggaatttggaaggtgattagtttatgagggcagagccttcacaaatgtgattagtgctcttataaagagaccccagagagctccctcaccaattctgtcatctgaggcttctattttatagaaggagaaaatatggtatagagattagatataataagtggaagagctacaattagaattcatgtctgtctctaagtccacaacatctctttcttggatatatcttactatcatacatatgtatgcctatgaaccagaaagcagaccctcaccagacactgcctctgccaatgccttgatcttggacttcccagtctccagaactggagaaataaatgcttgttgtttaagttacccagtctatggtatttctgttacagtagcccaaatttagctctcaattatcaaagcaatctacacagctcctaaagtcaaactctacatatagaaagtaggtgatgaataaatctgcattgactgatttaattgattaaaccaagttgactgatttaatttattaaatcaattctaattcattgatggctatcagctgtttcctcagaaatcttgactattaatatctttttttttggcaatgtttatccatgtatgtgattattttttgaccttctgtgatcttgtaattgaaaatgctaacaaatcttatctacagatgttgctggagtaataaatactattgtacattgtccttatttctgttgttaactttttggtgaatttaaatcagcttacattttttccatgcctactctataggttagattgtttttaggcttgtgattctgtgttgcttgaaaggattccaatttaaaatttttctgtacagttttaaactgcaaatgagtaataaatgtatttattatgtggattattgtggtacttaccttcaacctttgggattgactgaaggtagagacacagatttcataaatattcagttgaaaatagcgtttgtttgtttcttttagtatttgccaattcaaatgccagattttatatgactgatatttgttaaaaagccagatatttgtgaggtttagatacatggatcttaaaaaatcatttattatcatttgcagccttaaaaatggatcaagcattatggaaggaaaaaagaagtttagagatctagagtcactgaatactaatgagtcttatggttcatcagatggtttatgtttatgtttcttgtgacattaaagcttcaatattttacattgttatcgttattttttagaagaaggtatggcttagagattatatgtaatgagtggaaagccacattcagaattcaaatctgtgtctaaatccacagtgcctttttcttggacatatcatactatcatatattatagatctatacatgtttgctattataattgctactagattgcttttccagaaatcttaccttctatttcttttgtcctaacgtgttccatctatgttacctagctaggtgataaaatagtgtataataaacttttaaaagctgtttacctaaaaatatttctttgagactatctgtatacatggtaacgccctcgtacctctgtcaggtctggggtgtttctgagccttctatggatggtctatgcccccataatgccaatggcaggaagtaaataccctgcaaccttaactttgctctgtaacatacatcgaagtgtcatttccttgtgattttagtcctttacaaagattttggtgaaataacttctagtgttttctttcaagagtccttgaggtctgggataaagacaatcagggggcgtatttaagaggtttcactcagaattaaccttgcccaccttcctcaaatctggcccacctttctttccttccttccttccttccttccttccttcctttcttccttccttccttccttccttctctctctctctttccctccctccctccctccctccctcccttccttccttccttctctctctttttttgtttttttgacagagtttcgctcttgtcacctagggtggagtgcaatggcgcgaacttgtcccactgcagcctccacctcccgggttcaagcaattctcctgcctcagcctcccagtagctgagattacaggtgtataccaccacgcccagctaatttttgtattattagtagagatggggttttaccatgttggtcaggctggtcttgaactcctgacctcaggtgatccgcctgcctaggcctcccaaagtgctgggactacaggtgtgagccaccatgcctggtgtggcccatttctttaaatcaaatgtgtttgcctgtattttccctttctttagtataaattagtttcttgaatgcatggagataccctggataaatattaataaatctcttaaaagaacatctcatctgctcttccaaactttcccatagtgaatacagtctatatgttcaaagtaagcactgtccttgcccttcgcttgcctttttaataatagatatcacgaaattctccagaagaactaacagttagttgagtttctgaagaggaattcctacccttacactgcacttttggtcttttcttctcctccccctccccctcctccccctccccttcctccccctcctcctcctccccctcctccccctccccctcccctccccctcctcctccccctccccccctctcttttttgtctgaccctttgttccattgttgatatttatttttcttattgatagtaacattgctccttttgagttatcggggtgggtaatgtttatatagctttctgccacacagccctaacctccatttggcctaatgttccaatctgtgaatgctgcagcgaagtggtggaatgcagtggggtagtgacaaaaaaaataccagatgtaaaaggatgctactaatttagaaaatgaatacaaattaaataaaggctgagggagacttttttcaaatgcttaattggttatttgacacatatccataggtatgctctactgtatgtagaatgagaagaaattactcctattcatagtttgtctcctacttacgtgatgttgagagcaagttgtataacttctttcatcaggtagggtagagacaaggactctggaataggtagcctctatttaaattccagctggtccaccatttagctggtgacttaagggagctcaagctcgataacatctgtttactcctttgtaaaatggaactaatgggagtatgtactaagtttgtaggaaatatagataatttctgtaaagtgcttggtaaagagtaagtagtgaaaatatatcagcccttctttatttctcattatgatgttcaactgagataccatatgtaaaagaaatttcataaactgtaaaacatacacattttaaccatcattattcttaataacatgatgtatactgtataatgaatgtaattttaatttttcttaaaaaggaaaagaagaaggcttcttgaactttgtacttgagactcgagagcttaaaatttgtcactgcttagaagctttatatctaaaaaacgtgagtggaaaattacaggataatagtatgagaattattgaaagaatctttgataatgtcagttactggagcttttaccgaaatcattaaaactcacttaagaagaagagaaataataatagtattactcaaattaaaataaaaactaaagagctactgaatattttacagcattaaaaaaatcatgttctctagaaaaaggggaaaacagaggtggcatatttttttcagattattagtggatgatgtttctgccatttaagaaaccaagtaaatttatattttacaaatttgattgattgatttacacatcatagtaattttccaactcctaggaggaaagattacaaagtgagaggggcatatagtacactctttgccacagaatgtgatacatccatccccctccatgtattaacaaaaaaaaaaaaaaaaaagaggaaaccgatgtttccacagcaacgttagcaaaacagaaaatttgcctaccgtctaagatcacacttttcatttttttttttttaaaaccatcctactcactgaattggcagcctgtgcaagttaattaaactcaaaggtaaattatttaaaggtaaaaggaaattaatataacaagtcaggaatgataaatagtttaccaccagtcaaagaataggttgagataactggaaatgaatcccctttgatataagaagagtcagagtgtgggtggtgggaggagcagagctggagatgacaaatcattattgcaaaattaaaaggactggaagtggttcaccagatagaatctgacacaatcttgggagcgtaacgtacgttgaccacagtcatacatacctatttgattagaccttccataaaataaaagaaccctgtcctccttttcctccttcttcattcataatagctaatgttgaataagatgtcgctactctgttttgcaaaaatctcttctttttgcaatgtttttctcaattttttataaaaattcctaaaaaattctgtgaaatgggtatttctctccattttatagaagaagaaccagaagttcagagaaattttaaaaactctcctctacccatattttcaaagtcagtatgtgttttatggtttcttatattcttaattgtacaaaattttaactaaaaataaaaaccaaattgagaattatattcagaataactgaagtgaaaacttgatgatatttttagttaccatgtattattgggacagtactgcattttctagttctttaaatttatgtgtagtatctgcccatcttaaatacctatttaagaccagtttgggggcaatgtaagataatggatatctctctgccaggtgatttggaaagttaatcattcaggctgttttaaaactcttggattatgacaaggtcaatataatgataaacactctagggattgtaaaatgttgaaaaatatatgagaaaagtgatggtccttactgataaaataaaccttttaagttagttttcactatggaggtcaaaataagttttgttgattttatctacccttcctgcgcctcactttttttttttttttttaagatggagtctcacactattgcccgggctggagtgcaatggtgcaatctccgcttactgcatcttccgcctcccaggttcacgtgattctcctgcctcagccttctgagtagctgggattacaggagcacaccaccatacccggctaattttctgtatttttagtagagacggggtttcactatgttggccagacaggtctcgaactcccgacttcgtgatccgccctcctcatcctcccaaagtgctgggattataggtgggacccaccgtgcctgggcaatcaatttttattcatctcatttcatatatgcatatgcaagcttattcatgtatatgtgaatgaaaagatttgtaaagtatgttcttttgtcagatgtatattaaatttttgtattcttatctccaattaaattatttgaagagttgatttttagatttaccttttattccttcttaaaattaaaaaaaaaacgcagaaaaaagtaccaaaaataattttcaaaggtacttcttaccctattatactacattttacagttttttgttcattatgtcaatttagatcatgtccagttacattttgtttttgttattttggtagaataatcagacccacatgaactttgatatatttgtagacttttgtaaagacagaaccttatatgcaacaatctgatagtgagatggggcctttccatattttttcctttttaaagtggttgtgtagtttaattcttttacctaattcctacagagatttgatcattttcttatgagtatagcagttttcttccttctaccttttataaactttaatgcatttggcaaccagaatactaaaataaaatgaaatcctgaagcctacacaaattcctgcaaattgtgagtaatgggctcacaaggacaagcaagtttgagcatcctccatccaagaaagaaaggaaaaaaggaagggaaaggagaattataaagactatacacagtacatttcaaagaaaaaaattagaaaagataattttagacaattacaaaatgaaattttgttaatgcaaattaataaattttaggacattttattgaggatttaataacatttccaatatacatttgattgtaataatatattatgctgtcactttacatattttgtctaaaaagcaaatatcatttttcctttttattttactgttttcacattaaagttaattggctcagagacaaagttcatcaaattacaataatcactaaaagaataagttacaattaaatttctgaatgggtatcattccagtgacttctgtttcctttacaaggtttattttttcaaaagagctttagaacacgtaagttgtagttgttgttttatttccctcagatatgagagcttgcttttttaagataatctaaaacttttccttgaacgatgctgtgaagttttcttttagagcagtgcttctcaaacttcaatgcacattagaataacctggatgtttgttaacccatagattcacagggcccactccagtagtttctcattcagtagacctagggagagatttgagaatttgcatgtctaacaagatgcaggtgatgctgccccagcgggtctgggcacactttgagaagtactgttctaaagacatcgtgactcttaaggtccaaaatgcagagtcaccaaagaattgctgaagacaaaataaagatgacactagttaaatgatagtgagagtctgaagccagagagatggatcagtgaacactttgacaagctggctcagccagacatggtgtgtcataaatttgtttaacatggttactgccttgacatccatttctaggcctcacataagttgtttcaaacccagtaataccccattactttcggcctggttaaaacttctcttcccctcgtagtcgtttttgatatgaccttcttgtttctcatctcactgacgcaaaaaaaaaaaaaaaaaaaaaaaaaaaaaaaaaaaatccgacatgccccacagctgctgaccatgataaacctaatggccaacaccagagttacataaataagttcccccttctggcatgttttcttcaaactagccaatctgcaacacctgcgagaaagcctgagcaccttaagaaaggcatagtcccagagatcctcctcactgtctctgcctgtctctgtctctatttctctctgtccctcttccccccacctgccacctgctagctgagctccctgtcacctcaagacttcccactggcctcctgttgacccccgcaacctctctgggatctgtaagtaatgcatttcttctgttttatgcattttagtttcacctccacattgtatcttacccgtcccataggactaattcctcctcacaacccagcgcctcatcagggctctcctagagagtggctttcttgctttctggccactctcaatagagttttcaagaccaaattagaaaccgtaacaacaaaaagtacaacatgggtgtcaagaaatgtaaagggtctgagattttgccctaattgcaacctaataagctagccgaccacaatttcacagatgcaggagataccctgattcagacacagtggaccttatgcctcatggcacagtaggtagcgtgagctttgtgttcgcatcagtatctctggactctcaaacccagtgaggttgctgctgaatgacccaagggcctatggtgtatgcaatggtatgtgttacagctgatgaaccctgagtttgggaaaccccagtcatctaaaggggtctgccaggacaccgcacttgcctcagaggatcacttttattttttggggcaagaaacaaatctgccctcgctctggagggagacactatctctatattccaaggctgtttgctatgcattcttgaaaaactagtctctctttgcctctgttcatgtgacatgcagaaacatgagggacccgaggagaaatttctctcaatatggtgattgaaattgggactaattcagaggactaatatggtcaaaacaattctgaagtttctagtctcagcgaaggtatgccctttccaataactttattatggaaataatttaagatggctttttttttctctcaggtgtatgtaatattttttggtgataattttaagaattcagtttattgactttatgacgagtctaacttctcccccttagtttttaatatataatagcttctgtttattgaatactaagcacatatcatacttaccccttataatacaaaatgatatatgcactactaaaattctcattttatagttgagaaattgtggtaaaagttattaatatgctgctggtcataagtggcagagctgtttttactatattatgcttccttagttattcatggtagtaaaaaataattgctagatatgtaaaggagcggtcacatgggacataaaacaaccattttagggcaacttaggttggtgtttatttgtaggcaatttggttgttatgcaaagtgattgaaggcctttggaattagtgtgacataccagaatgcagttctcaagctgaagagatatttgcattctctgagtggatgatctcctaatgtaaatagtttgatgttgtgacttaattttgtgggattttagactagattatcagcaggactatagtattaggaatggtcctcttttctgtttgtttttttcctctccacagtccattttctctcccttctccacagtgattccttcctgggtttttgaatctgcagcagtcaacatgtagagaataaggtaactgaataaggtcttagaattttagaatctaaaattctaagaccccagagtggaattacatggattagggtgtatccttgccacttccctagccatattctactactttttaagtgacaggtagtgttgagttaatctagcaatttttaagaattaggtggtgatgtatgcttgtcgtgtaggaggacagcttttgtggccagaaagtcacagaatgtcaaagtattataatactgaatgacgatgacttggtgaacctagttatagatgttgatacaaccttgaaaatgcttggaaatgattgtttccacatttccatacacacttactgaatgcctacactgttctgcacgttgtataagatactggaggtgcgcagatgtgaaagaactgcttcctgcactggatgaacgcacatttagtgatttagagggagggcgaattgagtatagcatgatgggccatgatagcatgaggttatagaactagtgaagggcatggactgttttgttgtctcaggataattatattgctatttagaacagtgcttcttaaaaagtaactcaatccatatgtctaatagctccaaaatattaccctctagaagagtgttttcaaggtttatctatggaaaaggtgtaatatattaaacgtagattttcaggaatgacaccagctatagaatcagaatctttggatgatggtgggattggaggggttttcatggggtccaggtgtgttcaacaagttcaacacgtaattcattgcaggtggcaaaacgtagagctgcaaattatattcatttggacaaccttttattttgcgctgtagacccaaaagaaggtatgataattgttgtgtattatttattttcatactgctaaaaggagttttgttctcaccagatgatatctcccttaccctgccttctgtatttcaagggtcttccaatttatttggaaataattacatctctgaagattagatttgaagctttgtggttaattttgaagtatttcatgaatatggcagatcaggttgaaatctataggacacactccagaagctatgaggcgaaagttttatttttcacttggccacagatcgaaaaataaatgactggctttatttcagcaagttttatttatatgttttgcatatattacactcccttaaagcttaggctagaaagagaaattgtatttgtattatgagatttttatttcccataatctggcatgaaatcagttgtaagaaaatgatagctatcaaaaagagttaatctgtatccttacattataccttgtacattataagatttatctgtaatgtggctgcaaaaattttttagcaagcataagtaaaacatataaacagtgtttagtcatctttataagggtgggcttgctaacctatagcacaataatgagaggggatcaacatgtctttggttaagttgccttgcttaagttatgatttagaatctttcaaattgcatcatgagtgcctgtgaagaaagattgatggtctcttgatggagtgaaggaataggtaggtttgtattaagaaataatacctattctacattctgttagtaaatatgcaattgatgtataacattttgatgctgaaaaaaatcttagaaatggctccagcttagtttccctgaggggttttgtcctcctccagatattatcttaactttccaaaaccttcagcaaataatttctcatacaccattgattgtaatttgtttgttcaatccaaaccttgaaagggtgatgggtttcttcttagataaatcattcctcatgaaacttgtggaatttctctttgcatgtagcctattagcaaggagaatcaacaataccaatatcagatgatatttacatattttttaaaaatacacttccaaccaatgcctaaggttatagatcaatttattatggtgattgctctgtgtagggaaattggtcagaagaggtgaataaggtgaacttcaaggtgatttgtaatacttttttttcttacataaagttataaagcaaatataaagatcaaggtgaattctggggtggtaggctcgagactatttctgtgcttttcagtattttcagcttccccaataccctccagcccgccccccaacccccgccaaaaaaaaaaaaaaaaaaatagagacctgtagctaaatcttgtcattggctaatgacactatttttaggatccttcctgtcctttgagatatttgcatcatgatagaagcagtactttaaaaatgtattctccatgtggcagaggccactgaaataaagtaaaatgaataaagcatgtatagtttaactattgagaaagcatctgtaaaacaccacatgatattatgtgtgagtgtatatgatgtatatggtatatgaatataaggtccctttagaagcatagttgataaaactatgtcttatattttttattctgtgaacttgcatataacgagccttagtaaatatttattgaatagaagcaaacacactaggcttcttgtcctagaaataacttttccccctagtcagggtatttatctagttgctacaattatcaaatgttgaaatgtaccaaagttaactcatcctggttagtctgtttacattttataacttttaatcctcaaatcccagtttccagcctggcttctttagctaacagaaccttttcagagtactaataatatttctttatagaaacatttttaacaatctgtaagtacagcacatgtgatttaaacatacagagcaatttctctgcacatgaagattttcctagtaaaatccttgttcactaggatataacaaattgttagaagcctttggtagaattctgctgaacatacatgtttatatgaatttcagctgcattgtttcccattatctagttaaggttattggaaaaagaacattttacctttgagatggaatattatactcaatattcatggaagtattatgctgttatgtctgttgaggtcttcaagacttcctatcagcataagaaatgctgaagaaatgtcacaccttgcctatacccttctctgcccttcagaaaaaataaggtgtcacaggcagaacacaatgatcttctctgctttcttattctatttgtggtaaaaataaaataaaattgaacttattttactgaactgagctgttgtattccctgaattgcatatgcttttggttaccctatggttttatagaccagagctttcctgcagggtaaaatacagtgaaaacttaaggtctactaagattttttttcatttatttcgctcatatgtacgtgttgaagaggtcattggtgattatagttctgacatagcctattctacgggttcatgtttgtcaggttcaaacggaagcaaaactttactgagtttgtattatgctagatatgtagaatgccaagtagaaaatgtaaggttaagaaaatcctagatgcaaaattgttagctttattaccaaaattttgttgttagtgaaaagcagcaccagaattggaaaccagatctgtctgatttaccagtgcatgttcattgtaccatagatccaaagtaattgattgtatctgtaggcttttctttcgaacattgaagtctgtttattcacctaagtctgctattttcagtaggtattgttagaaaattcaaatgattatcctgatccttttgatatgctaagaaccgtttgatgaagatagtaggtgaaactcctagagtgataattgaattgtcaacataggtataatacaagaatttgctaatctttattgggtgttaactgtttgaagattaatcacataacacatgcatattttatttggattagctgttgtagatctctattaccttttattaaaaaggaaaatcttgacttacattagctgaagaaattgttttgaaatttagtgatatttgtttaaatggtgtctgtaagtcaaatctttgtatataaacaagagtaccaacattatgggagtgtaactgaactgttatatgatccctgatgatttttttttaaagctatcaaaagaaaatttctcataatttcagaaagcaaattttatctttaacttgcaataaatttgcaatctaggaagcaagttacttacatgtttggaaaatagtcttttttttggaaaaatatatgtggatattgattaggatagtagaattatatctttatatactgtataatactgcttttatagaagtttatatcacctgacagaattcaacgctaatggaaaagatgaagatatgacaaaaagtaaaggttgagaatgaatagactttcaagggagctgatctttctgtgatctgataaaacctcttcattctctatccttctccctgcagaccactgcatagcaaaagcgtttttactgattagcaataatctcccaggatttgaggacaagacctgtaaagatggttcccaactaaaatatgatttttgttgttgctgctggctttgtttttcattttttagtaatttctaaaaccttgctggggatttttttattaacctaaaattgaattctagtgttttggttttgatattactctgtcttcatatatactctgatgagttttataggaatctaaagaatggtcttgtggaaggagcataagctttggagtcagaaagtctggggtcaagtctattttgttatagttgtaagtccttaaaacctttatagtgattttctattttaaatgttcaaaccaataagtaggtagggatgtatacattcttaacacatctattactttttataaatacttatttgatatccaaaggattttcatatatacatgtggtatctcagttacaataaagccatttaataaaccttgctgaatatcgtaatattagcagaattaagcttcaaatttttctcataggtattcattgtaatccaggttttttatttctgtgtggtgctcagtctggttttaaggtctgatactatattatgctgtgccataaatcagaaaagtgttctgttttttatttttttttttctgaagtaagttattgttacaggatatacttatatagccaactatggaaacagggatgttctgttgagcagatactcacattttattgggtattttgtgtcttttttttttttttttttttttttttgagacagggtcttgcactatagctcaggctgcagtgcagtggtaccatcatagatcactgtaactttgaactcctggattcaagtgaccctcctgcctcagccccctgagtagctgggatgataggcatgtgccaccatgcctggctaattgtgttatttttttagagacaggatctcactatgctgcccaggctggtcttgaactcctggcctcaagagattttccccacctccccttcccaaagtattgggattacaggcatgagccatgtgcctggcctttgacagccttaacacaattcaccggtgccatttaatggtagctcattagctttaaaaataaaatgtcatttgaccaaaacagaagtgaattaaaggcttaaagtgtctagaagacatgtcggttttctataagtaatgaccggctggtttgtagcaccacccagtgactgttgactctagtcccgagatagactaagtctctaaagtttagtattatatgctttgtcatgaaatttgctaggtaaaaatatttattaatttcttcatgaacaaagaaattaacaggagtagagttttcatgattatatatttctaaaattccaacctggggatatgaaatttagcaactttcaagcttcagaccagccttttaaaatacataacttctttggtatacataacttcatgcctttatttttctaaaaacattttcagagtcttgcaatacagggcatttactttataaaattagtgttcaaaatacatataaataaagccgatttggactatcttcctcctagggaattgtgttatagtttgttgccactgttattctgtttctctggaaatagttaactgtgatgattactgtcactataacttactaaacatggattatgttcatgtcataagccacgtgattctgggtcagatcagttgaattgcactttctcatgcactcccaaggaggaaagatctggtagagttaacagctggtaccttggaaactgcatagccctgtgggtgaatgctcactagtgtgttttgtttgctgaaacagcatcttcctgtgtattctgaagaaaaaacttaatattcttctctaagacacaaagacatcttagagttctaatgtttcttaatctaaaaaggtttagtattttattcagaattttgtttaagttccagaattttttttttgcccatacatgtaaaagtttagttactattattatactgcttttttttttttttaaatgggggaagatttacattgcaaattttgtcaagggcatgtctttggccgggcaggatggctcatgtgtgtaataccagcactttgggaggctgagataggaggataatttgaggctaggagtttgagaccccatctttaccaaaaaaaaaaaaaaaaaaaaaaaagccgggtttcttgatgcaaacctgtagtcccagctacttaggaggctgaagtgggaggatcacttgagcccaggaggtcaaggctgcagggagctatgattgcaccactgtactccaggctgggagacagagtgagaccctatatcaaaacaaagaaaaaaagaaaaagccttcatgcttattttctcattctatcttctctttccttatcttcccatactgaagtgtttctatagaagagttgcttccatttccattccttttgccattttattcatgttttgcttcatttttcatgtgaagttgagtttctaaaagtattatgatgcagtgttcctgaaatgtatatgcttgtcttttggctttgctgcttagttttttgtttttgtagggagagggagccgccttttggttactctatgtggtacaatttctaacatttcctagcttcttatatactccatttctacctagtagtgaaaaacaaaaccattgtccttttggcacactatgatagattttcacttaaatttagctttgggactcttaaattgagatctcccactaggcaatattatagagtcactgataaaacctatgcaacagcttagaaaaatgaatagattataatcacagggatagaagccaatacattaatataaaaactggtctagaaggatgtttatccagtgtagactggacctccacaggaagaacttacgctaaggaatagttcatagatcacaaacagcatgaatcaataaatgactctgagatttgtaattttttaaacctaacctgataatttctataccttaataagtgagtttagtatatttattatatttacttttctgtttgctcagttttatcactatcttctagctgcataaggcaaaccacaaataaactcaacactgcactattttctctaggggatccagggagaaaacagaaccattactctttgaagttgatagttgacatatatattgtttagtttgtgccaggcactgttctaagcactttgtaactcatttagtccttccaataagccatgaggcaggctttcacattactcacatgagagaatgggagaagagtcttaacttttcccaaggttgcacagctagtagtttgcaagggctgatattcaaatctaggcagtcgggtccccaactctgtgttcctaaccattaaatgtcactgtcttatgaaagcctatcacatggagaacatcatagtgaagttgaaaaatacaaagagaaaagtctaaaagctattggaataggggaaaaaaaagtttataaaaagtgattggcaggctgacactagcaatgtcatctcccactgaacttaatggaatagcatttcgaaagtgctataggaaaataaattggcttataattcttaactactttagcatacacgattgaaggtgaaataaagcaattttaagatgcacaaatcctctatcaaagattatcgctgaaagaactactaaagatgtacttcatcaaaggggaagttatttcagcttttgtggcttttggtaaaaactcaatatgcatttaagaaggtgcctagtatattgtttagtgcatattaatctctcaatgtcattttttaagagaaatgtatgctccaaaggtatttactaaaaataagattctatgaaaattagtatacttaagtgtttttctaaaaactgaagtattagtcattgaaagaaagcactcatagaggacactatagctgatgatggcagaggtaacaaacttaatggtattcaagaatagtatattatttatattgctgaagagtaaatatacaaacatcaactttagtaggttagattactaaatgatttagaatttatgaatcataaataaggatcatcttctgctttttatgtcctcaaaattgattagaaagcgcaagcattttatataacaattccatattacgtgttcatttgaattctaagatttattgtttgtttttcagcgcctggcattggaagcggagaaagttcaagcagctcaccagtggagagaagattttgcagtaagaaccccttttaactacttgatttaaatagcttgacatattgtgtatggataattacatgcatattaaaatatattttaatgatggaatcttatgatgttgtgggattaaaaataatcatacttgttgctttttaaataaattgcttttgggtaatcagggccaattaagttagccaaaatgtactttatgttccatattaccaaaaaaaaacaaaaaccaaaaaaccctttaaaacccttgaaatgttctcccataattaaaggtacattatttataaaatacattaaaaatagcattaaattttaatatctgaataatttttgtcgatattatgaatatacaagttggaaaaagttgcttttaactactttgagtttgtaagaagcagtatacatattataatcaccttgatggtgggcaatatgatgaaagtgagaatgaatatattcaacttcttaaaatttaatttgcttcactttagctagaagtaatctctcttctactctggcctactttgagaaatgtcagctgacattagcggttgcatgttttttttttcttaataaacttgttttatgaactaagagttactagtttatagaaatagcagaaattctccttgtggtaaggtctgcatatctatcatttatctatcctcttatagccaaggggcacagtaaaaaaaaaaaaattccttaataatcagaaagtacttctgttacatacttgagtgattacagttgtagtgaaagaaaatctttataatttctgatcacagaaaacttccagacaactcattttggggatgtaaacaactgccctctaccttcccacatttaaaataggtttagaatgtgagcgacagcttaattgtactctttgcaaagcaaaagtctcaaatttgaaggtatgtagttgtgcttcagtagacactaaactgaggtttaagaattagcacttctttgtgtttctatgattatgttgaatatcaaaggaaaatgcactaaatgatatttaattcatgtatataatagtcttccattcttgatacttgtgatattatttatttttactgtttatcacttatttatatattttaaacagtctactaatgagagactctatttgacaactgccagtttgtttgattctctactgaactgatcatatcacttaacttgattggtattaatattatgtaggtattggctttgtctacaacctttatcatacacaggttaataaagatcaatttgctatccatgatatattaaggaaaaaatcaatgattaagctaaaaacataagctcctagagcatcgagcaaactgtaagctcatctagtgaatgaagaggcttacaatatacttagttgcttttagataaaaacgattttttttgtttttgcaaatagggaaaaagcagcaaaacaaatctagctaaatatatgtttgattaacaacattaaatataaattactcttcccttatgtcccacaacataaagcgtgcatggtaaaagcagtgtaaagtcataatagatgtatggctagatcatgtattctgcctagcatagatataatacccttggtgctgttttagtttgaatcttcagtaattcggagaactcaaaacagacacacaaactcagcctctgaaatatatagattatacattccctgttcaaagcaccctttttctttgccttaaattcatttggtagtattttaagtagtcatttattagttgtatgttgttttcacttttctaaagagcaataatgtggaaaaaaataacttggcaagtagggttgtagtaatgcctatatcattgttgtttcatttaactattatttattaatttctagacataaggtttcatttcctagacattgtgaactctttaatattgggctcattaacactaacatttggcaattattttgttttctatattgaggtaatgggtaaccacaacacaaacacaatacaaaaactctaaattcaagtttgctattaccatattttattgaatgtaaatcatcaattgtaaggcacttagtcattctatttattttagttatttctaagaaaaagccacttggccgggcatggtggcttacacctgtaatcccagcactttgggaggccaaggtgggtggattactttaggccagaagttcaaaaccagccttgtcaacatggagaaaccctatctccactaaaaatacaaaaattagctgtgcgtggtggtgcatgcctgtaatcccagctacttggtaggctgaggcaggagaatcacttgaacctgggaggtggagggtgcagtgagccaagatcatgacactgtactactccagcctgggcaacagagagagacctcatctcccccaagcccccaccaaaaaagccacttaaattatgatgcatcagcaattgtatgctgtattcttagagatgtcaaaaagtgaaaaaaattatcttgaaatgtaacccttattttctacttttttggtgcctctatccaagtagcagtactgctaaaaaaacattgtgcaagaggacaaatcagtcccacaataatacaaaagccattactaaatcttctatggtgaaatagaaaatgaattatttgcccagtaagtattaggaattcttagcaaatggtggtcaccatgtgggagaattcttgaagaaattctgttcctaatttcccccttggttacctcacaatttatttagggcctgttgacatactgattgacatcaaaagagactgttaaagggaaaacaagttagaccacttagagtcctgtcaactcatttcctgagcatccttcctgaaggaccgtgaatgatgttgacaggacacaggtctgtcacagtttgcacattgagaattgctatttcccatatctaaccttggcagccatacatagtctttatgatagcccttccctttgaaatgccatagagtgatagaaggtttagatagtggtcgtttttgtgcttggagaatagaacctcaatgaagactatctaatcttaagactcaaataagtaaaaagtacaaaaataatacattcctctcagctttttttttgttcctaataaactaggtggtgctttagtgcacagatacagcaaggttaaataaatccttcaagaccagagcagaatacagttcaaattcgtggttgaaacttataaatcattaacattaaatctcttgttttgtgaaagcacacaaaacaattgtaaattttctcaatattttaaccaaacatttaaaaatggttaatttgaagataaattttatcatctttcaaaaggtccttcttttaaactttataattcttttatcttttaaggtatttaacaatgtgcatctgtgcaatatttctttaatgccatcctttaataatttaacactaagatgatttagaaggcagacataatttcctaaaaggtacattaacatttcaaagagcaatgtaatattctgattcttccctcaagtgtaagtaggcaagtttcattaatattacttaggcaaaatgttgattaaccttccctactgtgtaatgtagagaaatctcatgaacaacaagaacaaaaggcaaagcactaatatgctggcaacaacaaaggacttatgcaattcacactctctctcagctccattcaattcccaactgaatacacaattgagggaacaaagggcgtacaccctaaatggattaagatttatgtggtcatgcatttacaagttcaaactaatatttgtaaataagctatgtctaccagctgcctgctaggtctccatacaatttatgggtgttaaaggtgacatttcatgtcacttatgatggacaaattattctattaagggcaggtgggagaagcaaaaaagagcttggaaagctaattgttctgcatgaaataattgctatttctaccaaacagatcttttccaattgcatttcaaatctcatttgattgcattgcaatggttggttaactaaagcaattttgtttccaaggaagcttgcaatattaattgtacttacacatgtataaacataaggggtgtctaatttgtattttaataagtaggatctttatgtatggcttattagcaccagcttgttactgtgcaggcagagtacagacgtctagaaattggccggtaaataaaacatttgaagagtcccttttagcttcagcttcacaaagtaaattagaaggtgaaaatgtttctagtgaagttgtacgttattgagtgtccgtcaggctaatttagttctccagttatagctttaattttataatattaaaattactttgccaaatcatattttgaaatgttgatattttaaattttgtgtttatgcgagttaaactaataggcaccggcattatgtatttaatcatttcatctatccttattcatttcatgaaattgcatcgtttttattgattgtagcagaaacatttttgaatatgtggaatgggaaaacacactgtatttgttttacttagaatcgaagacagacagtcacttggtatgaggtcttggatattgaaagaactgacttttagggataaaaagtgagagcgtagcattgtcttaatgaataaataagtgaattttaatagatcaccaaaatgattttaggctctggctttatttagtctttcttagtttccacctttggttgaaacactcttgaaatcaagagcttgcatattttaatgtttttgcaacatttctgctatgtagggaaacaattttttgttacggctttttaagagtcttgagactttatcttcatcataaagatagattaaaagccataatgcaaagctcatttactccaaaattctggaaaaccaatgtaatgtaaaggagtcaggcgtatttgtgtgccttactgttgttgttcatgcatacgtataaatgccatggtaagagtattacaacaccagcataaaaaatattaaccatgggctttaaattgttagttatgctgggtgataacctatctcttttgttttttatattgaaaagaagcaaaatatttaatcattaattacctagtcaaaaacactggtttcacagttaacaatttttaatattttctaatgattttactgacctcactttccatttctattaaagccaaaatgacaatagtacgtgatagtacagtggaagcccctgcagtcagacatcatgatgatatgtcctgtgataaagtacatgtagatataaatgaggctgggtaaatttccttctttctcttccttccctctcctctcaggaaaggagggaaaagttaaaagaggacaaacacccttggcttaggaaatggggaggtagaaggtggttctctatattttcaggaccaatccgctgcttcaatatcctgggattgagatgatgaaaatagtgctaaattattgggagattcctgggattgctgccaatgtcctaaaaatttcagccatgcagagctgaatcatcctcattgatgtttagtctggagtagattactgccaccagctggtaccgaattgcagctgtcaaaagagggtttttgaactccaatttcattagcctctccgtaacttgagctacattttattaaaattgttgtatactgcttatttgcattaaaatgggagtgtactgtatttctgaactgcaaaataaaaaaattaagaaaaaaatacataagcattacaaattactgcaattttcatttaatgcataatctaagaagatttactccatatacgtatttccatccatttcatatccttgttcaaaaatcttcagtgactctccatttattaatagcatatatttagggtatactaagccctttatgacctggccccatctagcctttcctaaattttgtattgcataatctctccagcagctattactcctgtcctgaaattctaagctcaaagcagagtaaatgactggacatttccctagaacagtattcttttcttcactttcagaccttttgataatctctgcctagaaatttcttctttctccaatttcttcatatttttgatcaaccaatgttagattttttgtctaacaatgttatttctgttttatatgctccccaatgcccaatatatgtttaattcaagtatagctcactgtgtagttttcctttcttcacttttaactgctaaaatataaacttcttggggataaaaccgtggctaatgcattactaagaaaaccatagtctagtccaatatatgccagagtggcctatatacaattttttaattaaaaaataattacttgtagtattaggatatctgtttttgcttgtaagcattattgacaatattactgtggagataatgaaaatttgaactgcacttttacatgtctgaatatatctgtacacagctttggtatagtcatggcgcctcagtcttggagttgtgcaaatctacttcagattttaggtctgccaacaacttgctgtgcacttttagcaaaataatagcctatttgaatattaatttttttaatctaaaaactcttggctctgtgatctccagcagcataattattactgcaagatgcttgataattgtctttctctgcttctatgagtactatctctcttccaaggatgatatttctagaaaccccagggtttgtctcaggtgttcacaagcaagttggcacagtctcttgatggatatttgcctagtctagtgagcatctgccagctcctattactgttgtactatgtttgccattgcaacatcccaaagtgtgaagtctttgagctggattcaatgtgctctatgcaaaaatggggtgagtgcccctatttccaacccaaaaggtttttaataagagacctgaagctctttctcatactacctgtgtcacaaagttctgaagaaaacggctcattcatcatttatttaatcattctctctctaaaggcagaagtgcctttctttgtgtgtctttatttcttactttaccctcatcttctcaatgtctgtatgcattcttgtccatgtatttctccttctttaggaaatgataatcaattgacctccaggaactgaatgcatgaaaagacattcctgataacttgccatctccaaacatatattgttatcattcaggtttagcctagaggggacctattgctatatactttcatgtctccaaaaagttgtttttaaattaaatgagataatttatacaaatatgcctaaaattttggaaagtctttaaaaatgataattttaatatagaggtactatctcccttcagatgtatttcttcaaagaagttggaaaatgtggagactaatatatatttccatttattgtcaatccttcagaacagaaccctagggaaatcactgtattcccagagataatttttgtatgaagaataacatcagatgctggaataatttcaatttggtggagttatagatatattaatggctatgttaatattactgtgggaaagaggaaatgttccaggactcgaaggcctggcctgagagttttcttcctaaagggctgacactacagtgaaaattgaagctttaaaataaggaagcaaagtacaaggcacagatgattaatataggcatggggtgcagtcactagtggaatacattttgacattgggagctacccaggaaagctgaccccggggactgagggcttagtagactggtttcaatggagagataatatttgtccagagtactgaaaagggtctggattggggttgagagagtggatattgcaaccagaagcttagtcagaaaagatgtctctaagtagaaagaagatgcttttgagagatctgtcatttaaacttaaagtctcttaaaaaagaagaaatactaaagaatattcatctacatttttcttcaagttcttaagaagtttgtagctggatgtctgtactggatttgtttacatattaaagaaatgctataggaattgaaaggaatgaccagctctcccctgctgtgcaaaatgacctcctcctttaaagctcatgccttctgtggatagtctcatcaacttacaaccttccaaaccagcctagccgtggatttctttcttatgctatcttctctttcgttaatcaaaaagttttttcactttatcttttcatccacatacatactagctccagtatcttccaacattaaagaaaaaaaaaagtctattaccccttctagctctgccacatttctttgctgttttatactgcaaacctccaaaagttatgtggacctctgcatttttcacattttcacctttactcactggccagcccactccaatttgactttaaatttcatctatggtgaagctcttctttgtagttaacaactacctctatgtcatcaaatcgaatgagcatgttctatttatcttcacacttcatgtcttttcatcattttagtgcaccacttactgtatttcctttcttcaaacacttctttagttatcaggaaacctcactttccctgatttcctacttttcactacccattccttttcagtctttattggtaccttttcctttacagtacctctgtgtctttaatgttgtctaaatttagggcacagtctttgccctctcatctttaatgcccatattcctccaaggacacttgatccatattgttggatttacatgtaataacacccaaacctcttttctgagctttaggctcatttatccgatgacatgcttgctgttttcatttacctgtctcactggcatgtcaagactaacattcgcaagtgaactattatttctattacttttctccatcagcatcctgatcttctgttaagttttgcatctcaaaggatcactttctcctccagttaatatagctcaaattcaggagtaatcttaattcctttctctgccataactccacatgtagttaatctgcaaattttgtcaattccaactccaaaatttaccaagcaagcattcatttctcttcatctccactaacaacatttttccccagaaaacattcatatcctgcaggcagcataatcttgagattattaatcaaattatgaatcggaatccactccactattctttggtatccacaaaattgttttatagaattctaataatgaggttcagtacatgctaccccaaaatattttaagctgaaggaatcaaagaaaaccatgggggcagggaggtctctttgaccttccctcatgtctttctttcctgaagccataaaaccctcagagaaaggaaggaaaggaacatcctcatctctgaagatacagggatacaaagaaaaatctcaacaaacaggtcttgctgagtttcccccagcttatctccatcagatgaagcttttttaatccaatcagacttttccacaactatctacttgcccatcaaacctagcataaaaaatacacaaggtgccctgtttctttgggtcttcatttccttatgaaggctctcgtgtcacataaaacatatattaagtaaatgtatagcttttctattgttaaactcttattataggagtctcagctatggaacctaaaatgggatgaaaagatattttttccctacaatagtgacccagcatacacataggcaaataagatttttagtcagttaaatagaagagaatgatgagatttttttcttggaattaagaaacaattttataaaatagtagaaaatgccaggtgtggtggcttctgcccataatcccagcacttgggaggccaaggcatgaggatcacttgagcccaggatttcaagattagcctgggccacgtaaggagaccttgtctctacaaggtctacaattaaaaaattatctgggcatggtggcacacacctgtagtcccagctacttgggaggcgtgagcagtgattgtgctacagcactccagcctaggtaatggagcatttcttctcaccttccacatatctcccaaatcttattaaattattacttttacattaaggtttgtcttatgttctataataataaaaattctgacagtatttaatactgattttatattttgatggattaaattttatcagcaatacttttatgatagccccttcattactttatttcttttttaatttttttctttttaatttcataatttgattggattttgttaagtatgttgaccaaggaggtggtagaatgctctaatctgagttgttgtatgattaagaatatctggccttttcattttggacttgaaggttgccctggctaattatgtattattttcctcaaaattttgggacattgcttcactgtcttttgtcattcatagaggctagtaggaagtctgaaatcagtctgtttccagttcatagactcctcctatattgaactgatttttttcccactggtttccgaatgatacattcttcattcttgagattgaagtaggaataatacatcttgtacatcttatttttgattgtttggtgtctttatattaaagttttaattttatttcagagatataatgtttctgcatatttttgagagtgtgtgtatgttctctcttcatcaggaacatcacgttaattgagctacattttctgttttctataactggtattttctctttattacagtcttttttttaacatttcattttgcatgatttcctaaagcctgtcactaataatgtccttttcatatgcatctgtgctttggctgtgtacatgtctttcttctccattcttattttcacctgatttttttctctgttttctggcaacttccttgtcaacttatatcggttcataacatcagattctgaacccctttatcttttattttctttcactttttggggagatctctcatcaccattttgaagaacagatctgtaatttatctgagactgaagaataatgggtattattccttttattttaggatctcatgtgtttggttagtttttcttctttcaccttttgaaaaatatggatatggacggattcctgaatctctgaataagctagtgatttgatggaatatagggaagattaaaaggagaagatgctgaggtagcttggaaacttgatgaatagtctcaaatatcttacaaagtgtgcttcctttcaaacattccagtcagtttttttagcattcaagcagttgataagacttagggtaaaaaggattaagtcatggtttgtcttgcaatttgatgattaccatttttgctttcttactgggatttattttgtttcatacttttagctagaagttattaggaaaaagtagaaagctgcaggtagtacaattagcttgtacttcaaagccaaaataggcaatgtcaacataagtgttcctgaaaatatatgcagcatctgattatcccctagatacctgctagctattctaaattctggtcttaagttattagaaaatatgaagaaaagaaaatatgatgtaaaccagtacagcaatacagagagcagaaaatactctgatatttaaacagataccctaaagttaccatttgcacatgagatatattgattatacaacatagaatttactgtgcatctgactctattaaataggatatttgctgtttaacataaagtctatcttattttttgagccatgaagtaagtatcaaaactatcatgtgtagaagtaacatattctaataagtaggacctccagccaagatgacagaaatttagtcatttttccattgtgtaactttcagccaattatttaacctctaagccacagtttcctcatcaataaaataggactaatattgtttccagtagcacaagttattttgatacttaattgaaattattcacctaagacttcactgaggcttttgagtagactcaggcttaaataaaggacaatgagtaatgtcacattgtttacaaactgatattcccatgtgagctaaacaaacataactcaacttttattggcaatcaaatttactttctttttttttttaacttggtttccatttcccctgtttgctttgtagtggaatctgcaaggtatatagcaacctgtcattatcaaacacatttcacatacacattgccaatacatttcattgagactgattgtgttagcaaaagtgctaattccctattggaacataattttaaagctttgcaaagtgaatacatatgaactattaagtaaggagggcagtacagaataaaaatatccattttgataaattgtattcttgctttatgcaaatatatggaaacatatattataaacattatatatatagtttacatatgtttgtacaaagcaagaatataatttctcaaatgaatatccaatttattcattctgataaatatccagtttatcaaaatagatatgtttacatatattcagcatgctgaaaacatgttttcatatgtaaacatttgtatgtgtatatatattcagctatgctgaatatatatatgtaaacatatatgtttattcagcatgacttttaagctctagaaatgtcctgaaatcattactgcaatcttagtgtttctataaatgttggagtttgttaccttagaactcaacaattggtgaaatctaatacattttatcttttcatacttttatttgaaaatctgaggtatttatgttctgagcattttgggttttgaaacaaagagcattagttacactcaggagagggtagattacagaatgaaagttgtaataaatttaaactatctgtgtggccctattgctaaattcttttttcaaagtcctatgctgaaaatgactagatcatatattcaagataacgtaagcctgcttctttggctaggagggaatggaatgacctgacaaagagtattggtgtttctgttattttagtatcatagatgttgatcctgaggcttcccagaattgtctctatttttacaaggttttctctgacgttctgattcataaatttaataacctggattttaatcctcgaagtttcttctgtctcacaagtctttatttgtggtggcaatgggaaatggtggaatacatggatatggtggaaaaagacatgaataattttgatccacatatcaataaaatcacattataagccattttcatcaaactgcccacaggataagcatgaagagaacgttgtagaaatttagatcatgggattctctggtgtaggggctttatatggcctacttgattttgtttcttttcacagtattctgaaaatgtcaaggatatttcattgatgattataaattatcttgagccatgctctgttgactcacagtaaaaacagcatgacaagaaaagccaaggtctagctacaaaagcattgcttggccatgttgcaagctttgtgaatttagaaagacaggcaattgtaccataattcatagctatggctgagagagccatggagccgtatcctccaacagctttacattcctttagaagatgtaagattcaaggctacttgttgagcaaattaaattcatcaaaatatttttatttcaaagaatataaaacatctattgtgtggtttgataggaaatttacttaattatgttgatgctagtcagtttggtaatgtggaaactaaaacatttaagcaactttcatgacagattaataatgcatttataaacaggggcctttgagaaaaagttcaaccacatttaactcaagaaaaagttaaatctactcagcttttcatttcaatttacttgttcacaaagaaaaagatttaaaaaaacgtttaatatcttgattatacttgatattatgcacattgatctctcttattaaaagaaaataaatttatttactattatactaaaattatagttcttatttatatacttttaaagatatacagtcaaataaaatggggaggatatataattttcttttttaaaaataagtggactaacaatatattacttgcgaatgtagagcaaaagttgattacacagagagaactatttgagttgcttcaagattgatttatcacgttctcccttggaaaagactgatctatagcagtagtttaactgctttcaggctcccttggagccgtatttgtggcccacagctgggttataaagggcttcctgctgggataactgataccaaaagtaaatagaaagctagagtaaagagaagtcaacaaaacaagtaactaaatagccatgatgacactgattgtaactaaatttaaaagcaagattttctgaattaaagtaaaagcatggaaaattaagttaatcacatggtataccaacatatttcatttaaaattattttttaaaagtatgccattaaatattatgtaattacatttcaggtacaaatattttagaccttatatgctaacaccaaatcttatggtgatataaaaattcatttgtaattctaaacccactttttaatttttagtaaattgagtgttacaagaattaggtgagagggtaagtaaaaatatcaatgtgtgactattaaaagtatcaaagtgaatacattgactagtatgcaggatatatttcttagtattattttactgactacttgactgtgtttttcctcaacttgtagttgtctgtttcagctgctctttgcaaaatacacagtaattaagacagtaatttttatactctttcttcatgctgatgacatcttatattctgcaccttttcactctttgtcattttttaaaatgtcatcagcattatgctttggttggctagtagtagggagatttgcggaagcagagaccactttagagtcaaatctagctttgatgaaccaattttctgtttgctaatagcaaaaaataccacctgggaagctccaggagggaaccttttcatacagaagttgagagagttaggatttattattcttatagttagatatgcttgtttataaatatatttatttacacaaaaaaatgtatggtatatttgtagtgttatattagtaaatgaaaatgtaaatttgctctagaggaagtaacttgagcatttgtggttgatagacctggattcagatttcttttttggtacatacttactttgagacattggcttacctacctgaacatcagtttcctcatctgcaaattgtaataatgtatatctttttaatatttgtggtgagtactgtatgaaatggtctattagtcggttcttgcattgctataaagaaatacctgatactggataatttaaaaagaaaataggtttaactggcttatggttccataggctgtacagcaagcataatgctgacatctgtttggtttctagggagacctctggaaagttactatcacggcagaaggcaagggggagcaaggcatctcctgtggtgggagcaggagcaagacagaaaggggaggagggaggtgccacacactttacacaaccagttctcctgagaactcactctcatgagtacagcaccaaggagatggtgctgaaccattcataagaaactgccccatgatccagtcacctctcaccaggccccatctccaacactgaggattacaatttgacaggagacttgggtggggacgtagatccaaaccatatcagatagttttcatattgaatcaataaatggatagataccacattatcattattgcttataccttgttttactagaaatgactctacaaagaccaactagtgttcattttttataaaaggcaaagatttatacaatctgaaaacagaatatggcattcagtttctgaatcaaattttatacctctttaatttcagtacaatactcttcttcaatatttacgtgagcatgtattttttgtgtgcataccatatctttttttaaatttaagctcaaggatacatgtaaagaatgcgtaggttttttacttaggtatacatgtgtcatagtggtttgctgcacctattgaccagtcctctaagttccctccccttgtcccccaccacacaacaggccctggtgtgtgttgttccccttcctgtgtccatgtgttcaactcccacttaggagtgagaacagtacataccatacctttctactaatggaaggaaacttgagtgccagttatctcaggttctttgttctctgtacacgtacaaaactcacatacttcttgaagcatttgagcgttctgctgacaaatatttaaaaaattaaaagtgatattagactattgtctgctttttatacaaatatagataatcattacatatgcagatatatggggcagggtgagacacacagacgttatgtgaagcatctttttctgtttgttgagaactacacacattatgtttttcacggtcctacaggctttggttataagcagaagcttattgctcatggcaaaaaatctcatttatccttttcatcacatacagagaatcatgctagtgatcatgatttccttttctcccagtctgtcaagaagcttaacacaagatttaatgcttaattacaggattacaagctctgcaacagttatctttttcttcctcctaagtgtttttctttaaaactattatcattgaaatatttatttttaactgtgctgttcaatgggtgttttttttttatagtttgctctaagggtagaattgtatatcttagaacaatgatgcttggtaaggtttggtgggtggagggaggaatttgacaacttttcatcagaacattttaaaacaattttctttatccctatacataatccagttataaatcaatgactggtcaattaaacatcaagaagtagtcatacgaagctatagttaaaagctttaaggcattggaattcgtagtcatgatgattgtcacaaataaatttatattatatagttagagattctattacataatttgtcaattttagataccactttagatccaagggtcttttaaatgaagactggagaaaaatgtttccatgagcaactttagattgtgcaattgggcatttgtcttctacttaatggaaatttgaatttgagtttgtaatgattaaacttattagaaataagatctaaaaaatattttattaatcatatataatctgccacctagttctttcaagtttcctgttttgtttatatataactagtttgcttttagtgtccagatttttttatctcagttttaattcttcattaattcctgagagagctaggctcctggtcatctcaacagaataactggtggcaagaaaacttcaaaaaggaaaacagttatttaaggatcacttaaaatgctgagtttgtaggttttgccaaggtctcagcctttcatatacctttgacattaagaatagtgcctgtctgaaagtaatttcatttgatctagtgtgcaagtttagaaggattgcacaatctactttgaatgttactgcctggctgatcagttcacagaaatcagcttaggtgatcagtgggatggcagatattacagccatgtttccctcttatgaatgttctcgaaagttaataaattactaaattaccaatgcagccattttgatattgccttagtatgtttcaaaatgagaaattaaatgaacaatgcccaataattcttctatatgtaaaattggaagtaaccatcgaaacatataatgcatttaactaaagagttactccagttttgaaaaacagaaatacaccttggcctttctgggtaattacattttctaaggactggggctgtttgcaattttgatgtcattcctttaagatcatgttcctgacttaatttcaaagctagtgtttagtgatgtagcattctccccctccccaatttctgcaacaatattgaattttaaaatttatcagaaataatgtaaaatccatataaatgatataatactatctcataaatgaaagttgccagatttagtacagaaaaacacaggattcccagttacatttgaatttcaagtaactataccttttgtagaactttggaacatacttttactagaaagaattcatcatctaatcaaatttaattggatgtcctgtatttttcctgataaacctattagtattaatattttctcaaggttttaccttttctcaagtattaaccttttcttaaggttttaagaaaattcttagcctgagctcaactttgtatattaagatctaatttatttttggggggtgggggggcagtctctaaacaatttctagacaataggcgaattatattaatataaatgtggttttcatatcatttacatgatggtaaatggaaggcatattattatattaatacttataagcattgattaatcatttttaggattagcttgtcctctgtaaatatatagtttgatacatttaactttggaatataaagcttagatataatctcacttgatctgctttcagttcacttgttcttcttatgtgtttctagatctgctatgtttttactaaacagtccatgaaagtggacaaaaatatacaacatgttggaggaaaaaatacctccttctagttttgtagagagggaattgtgtctgtaaaggttaattaggtgctaatacattctctttattcttctcacctggatattaactttgaaattgcttgattctttaaatgtaaaatatttttcatactgagtttcttacgtgctagaaagaagttaatatgatcaaaagatgagtatgttgatgtgttcctttgttccataacacatctggaatcacagttgaaaatgtagacaactctgtaattggctcagcttctctgcagtatttttgctctccaccgaagtgacaccagcctcttatgactgaagtagttttatttagttctttagctattcagtttatcttctttttacctcaatttcttatttaaaaaccatccaaatttcttcatttatactgctctgaatttggaattctttgcctaattgataaatgagaagccaaaacaacttaggatagattgatttgttagcaaccatggactaagaattgcaccaaggaaaagaatgtagatttttaaatttgacattcagtgcatctgtattgccatgattcagcctttccttggtacaactttgtctgtaattttttggaaaagtatacagatcttcatttactactctaaagaaaagaaaagattgcatttactaaacaattatgcattttgaaattaaaataactcctatgaaaatatgcctgaggaatgaagcatggtccacagaattccctttccttgcctctcctttacttttttcttttaaatttggacaagagatgaaataaagaatacaatttaactagggctatgttgagagtcttttgaatttgttgagaatcttttggattgttgctttcagaaattaacattttaacaattatgcatgttttaactaaagacaggttatctctgaatcagtaaacagtttgaatttaaaaagctatttgaaatataacttaaatacagttactaaaactagggtaatgaaacataagctattagaaatttttgtttccaagcaattatatattattcaaatgtgcttctttaatgtgtgaagccatttcattttttttccttctgcaacagccttcctttctttgtgctgttaacaaaatttttttacaaagaagcagtacagatttaaactgtaatctatgccctataaaaacactgatttctacttcagttaaatacaaatgaatgtcatttaattatattaatgaaagagagcagcaattgatctgtagcaggtaatttatatcataatggggaaattgccagcttgtatttggtaggtgcaaaggggttgatttaggttagtttgtggatgtttctattgcaaacatctatccttggaacatagtcattacttttcaggaataaatgaatacaccttaacttgacctttcaagatagaaaaaaaatgatgcaaaggtttttcttttttacagttttacatgcttctacaaaaatatgtactagagatttcaatttttttttttttttttaagggaaagctttgctttgttttcagaataagagagatggctctttaagttctgttgggtgctcacatgagaagcaaaataatggcttactggggggaaaaaaaaagtagatgaacccagctactagggtgtttttttttgttgttgtttttgttttttttttttaatttgatctaaagcaaagcagttagtggaaacaccaaaccttaaaggtggaaggattctagagaccgtatttgtcaactgaatgtttatgtcacaggggaggaaccaaagcctcgggaagccacattactaactagtcaatgcttaaagccgtttaagcatttagccatgtgctcagtaagcattttaaaacactcactgcatgcctatagtagatgctgttggttccctgcccacatctcctcagtgcatgcacacacacatgcacacacacacacgcacatgtacacacacagagacacgcacatactcttgctctgtagcccaggctggagtgcagtggcgcgatctcggctgactgcaagctccgcctcccgggttcacgccattctcctgcctcagcttcctgagtagctgggactacaggcgcctaccaccacacccagctaatgtttttttttttgttgtttgtttgttttttttttgtatttttagtagagacagggttttaccgtattagccagggtggtctcgatctcctgaccttgtgatccgcctgccttggcctcccaaagtgctgggattacaggtgtgagcacccggccaagcacatactcttatagcttcctcctctaagcatctgcacatcttggccttgagggctttctcaggtggccagaatgagcaggagtgaacactccgagtgacagttggtatgggtggatactacctgagcctcctcattctttggatgtgaccgttttgagtgaaattctatatagcctccccagggttcctagggaaacagccccagttgtctacctgctcttgaccacagcttgtgtgccttggtgtctcacttctctactctcctattggtgtctcctgggatcacctcccaaataaatgatgctcaaatcctagtctcagtgtctatttctaggtaaccaaacctaggacagtgttaaaaaccagtcagtgaacatcttgtctgtggaatattaagataattcatcagatgattcaacaaccttatgagggaggctggcttgtttagtagttaatgacatctaagctgtgatgggccaggcattgagctcaaacatggctaaggtgtagtctctcacagggctcaggcaggtgatcacactatgctgtgctgagtacacagactgaggcagggaatgcagccgatccttgacccagatacttgcccatttcatcaatacaacaaaccagtgatgtgtagtgactcttctctctgatttatagagtggggaaatacaagaagattctatgagaggcattaagaagggtgtccagccgggtgtagtggctcacgcctgtaatcccaacattttgggaggctgaggtgagtggatcccctgaggtcaggagtttgagaccagcctggccaacatggtgaaaccctgcctcttttaaaaataaaaaattcgctgggcatggtagcaggcacctgcaatcccagctactcgggaggctgaggcaggagaatcacttgaacctgggaggcggaggttgcactgagccgagattgtgccactgcactccagctggtcgacaatagcaaaactccatctccaaaaaaacaaaaaacaaggttgtccaattttgacatgaagcagggaagctggggagttttctctggcaaagaaagcttcctggatgcacctttattttacttaataatgaaaagtctttattccagactcctagtagaaaatgtggcaaatttctcccaaacacacctcctttgctctcccactgtttcctacctataactggagccagtccatatacatgtcacttttagctctctccttcagcttttcttttgctctttcaatttaggaaattctcaatattcctttttctaatagggaggaacatcccttgacttttttttttttttctaactatgcctcatcatttagacttcttagttttgtcttatatgtaaaatcatctgtttttgaaacttacaaatctcctttctactttaacaagccttgcttttaagactattgccttataggaacataatgcactatccgagctgaacagtgatatatttgttttagctgttaccactttcacagaatagtgatgccagcataaagttaattattctatttgattattgttgttaatctcttactgtgcctaatatataaattaaaccttataagtttgtatacatattaatattatctgtatctgcagtgtcaggcctttactggggcgtcttggatgtttctcctggggatgagcaaggagtactgtatatatgtgaatgtttatttcataatagacacataataaatgtccctgtactacctttatttcctatcctacatatccctataagcccgatgaaagatgaatgaaattgatgtagtgattaccaacctaatgttctttgaggctccaattttgaacagattattttaaactaagttattcactgaccatagtgttaatcctcatattttgttttagtaggataataatctggagttgataatgattaatctggagaggaagggctaatattaccattggacaaattaacagctctcttgctaagacatcatatattatgatcaagtgctgttgacctggatcatgagtcaagaagatctgtggggtgtctgagtcaataggaagaaacataagaaatgaaatgttttagaagattaaattttaatgctttagatgattatatctaaagattcattggaattacagattaaaggagattaaagcaagttccacagcattatgaatgtgtttgttcagttctggaatgaggtttctgggagatttggtgcctgaggaaaataatatatttaccttctcatattctacctttgctcttctcatagagtttaaatcatatatttattgatatcatttggaacaccaaaatagcttacaggcagattcctattaaagtttatcagatgaataaataaattgatatagctcttaatgtttaataagaattgatctcctttgaagttcaagagccaatgaactctgaaatcagtctacttggaatttctccttgatttcctatgagagtgaaagtagcctaccttttaacttattcgagcttttgtaaagctctacactttttttttgactgttatgaattatgtgtatgtgtgcaggtatgtgtgtgtgtacttgttattttattagaatttctaatagctgctttttttttttttttttttttttttttttttttgagatgggagtcttgctatcacccaggctggagagcagtggtgctgactcggctcactgcaacctctgcccctgggatcaagtgattctcctgcctcagcctcccaagtagctgggattacaggtgtgtgccaccatggccaactaatttttgtattttagtaaaggcagggtttcaccatgatggccaggctgttgtcaaattcctgacctcaggtgatctacccgcctcggcctcccagagtgctgggattacaggcctgagtcaaggcgcctggccgaatttgtaatagttgctcataggcctatcatattcatttaatcatttatcagccctttcagtagcacttcatacagcattccagacactgctagcattgagtatatgcacaatagaacattgtctctactcaaactgtagtagcttaatcttcttacctgtaaaagatatatatatagatataaagatatatatctttatatatatataaatataaatatgtatatataaagatatatatttatatatatctttatatatataaatataaatatgtatatgtaaagatatatataaatatatatctttatatatataaatataaatatgtatatgtaaagatatatatatatcatttcttctacacacacacacacgcacacacacacacacgtatatatatatgtagaagaaatgagcagttccttttagtgaacgtcatgaatgtttctttcttctagggaggtatttccatttgtgtcaccagcatgatagttcagctctgggctgtagtacatgagtatctttgcagttaggttattaaacatagtaaagacacatggatctattatctttcgatgtgaccactcctcttagatggctttggcttgtagattggttaatatgccggacaacttatgaagtgatactttaatttacaggcaccataatgacaactgaaaaaataagcagactaaaatattacaattatgcaacggaaaataccggatgaagaaatgtaaagtgatatgtggcaaaagtaacagaagcaagcttacaaaaggccaaaattattttctagctttttgttgttcttccagtaagcgaaataaattaataataattttaaatttatattttaatgtagattataagacaaagttaaaagaatggataaagtgaatgaatgtgtctcaaagattaactattttattatgtaaactatttagagggtgtacatataggtatatatgtgtgtgtatatatatataaaattgtgtataatatatatacagaatgtgtgtgtatgtatgtatgtgcatatatataaaatttttacatataaaatttttatatgtaattttataatatatgtaaaatatataaattacatatataaattttatatgtaaaaattttatatatacgcacatatatacacacacattctgtatatatacagaatatacatacatacacacattctgtatctatacagtgaattttatatatataaaatataaacatatataaaaattatacatgtaatttatatataatttacataatatataatatgcaatatatataatacatatataatatataatatataatgtgtaatatataatatataaattatatattatatacaatttatatataatttatattttacataatttatatatttttattttttattttattttatatattttatataatttatatatttatataatttatattttatatatatataaaattcactgtctctaagatgtaggtcatgtctgcattcataatagcagtacacaggaggtataagtatttgattgaggataagaagactcagtttaactgttgctagtcttagcttttcaatacataaaatgacattgagaatatttaactcactgggtcatctttagtaatcagggtgtcaaaaaacacatgtgtttaggtttctaacctaaatcaggctgagcatgtgtacaaagctcaatgcttatttattcgtatgaaagaatgctgagaattcaaagaaggaacagattatgatttcattataatccatacattattgaaccacgctagcaaaatcattttactttaatctttttaaataaaactctgatattcaagcatgcaatcaaaatgtagagttatttgattttttattatgcaactaattttaaaggctagtgaagagttgatgtaaaaaaattgatccatcattttaaaaatggtaatgattactgatataccacttataaaatattaagttggcagtaggtgatttttgacctttagttcattagagaaatgttagaaaaatattaaaatgctttatataggagctaaggaaacattgaacttggcttctttgatgttttttttaaccttctgctagaattttaaattttaggtgaaaaaatatttcatgccagaacacatctgagtttttattccacaaattctcttagttgcattttgcaaattacctgaatgtgattaaataaaagatggatacacaggggagaaaaaggggatgatgaagaaatggaattcttaatgaatcagcaggagctagcatctaggacacagatttaggagttatttctagaacactgaaatttttgtaaagctacaaataaaaattaaactttaagcaaataatactattagtaatagaaaatcagattcgaagaaaacattgtaggaagtatggtattagtatcagtactatcgattgtgttggaaaccaaattcttactagcttaagaaaaaaaaatgatttttcctatcaccaagaagccaacagatgaaggaagcctcaaggattcaggctgtaaccagctcagcttttatgaccgtaactactcctagacctattacacccaaagaaatagagagatggaatacagtttttgaatatatttaggtacttgttaatttgtgtcatcagataagtggggtgatgtgatttactagccagacagaatcacatgattagattgggtgaataaacagtttctgaaaagctataggatttctgaatagaaaaacattttaccaaagaaccctacatgtttgttagagtttttaaaacatagaaactcctgatttactggtgtgtaattttctccagcaagattgggcagtttggatgttgggatggacaagcaaacttttagattaatacaaggtgaaagtttttataggcagtaatgaatgatgattgatatgtggaggtgtacatgtagactggagagttacagaatcacacaggtctggagcacagcaacacatttggtggacaggatgcgtataagccccttccactccaattaattaccatttgcattaggctttcttataaatcatctcatttggtttatcagattaaaaagcatgacaacaactagtaattttatttcttctccactctgctatgtggaatctttgaagatagcacttaaaagacacattgcatcctaactgatctaagaaaataaaattataatttacttcatgtataagtaggtattaactaaagttaattgataaattctatggatgtatattcctgatatttttcatatataaaaagtagttaacaattacggggcatatattgtgtgccatgcactgtacttaacactttatatcaattatcttattgtctcttgtcacataatatgaatgcaggtttatcacgtcttcagttcagttatatggtagcacttatctctagatggtcttgtgtccatctttattttttcttttcatcttctaaattacatactttctcaatatgttcatgttttccaaacttcaaacaaatataatgacaggaaaaaatactttttttcctggagcactgtcttgaaaatgatttactcacattcatatcccccctcaccactgacacccacagacagccatacacacacatacatgttcctaagttcttttattcacacagtgttacagtgctgttggttgaactcatcccaggtacaacagttgataatggacaaaatagcagtggttgctaagtcaaattgctacaaatgtatttccagaaaatttgagctataaatgattttagctaaacagtgtagatgttggctggcatgaatcattaacataacttatttttaatgaagagtatctacaatgtttaaccaattgacttggtatttggaactcaggagtgataaaaatgacaataagattgcaatattttgtaaaagtgactttatcagacagtacagttgcccaaaacttgtcaggctgtgaatcatgtgcagagctgagtatagccaagaaagagaattagtaaattggacaggaagttagtctctatttgaattttgaatgtgtcatatattttaattgttgactataaaatcttaattttcagttgcaatatttaagccttattcctggcaacatcttagttccatggggaagctttgcatgtgtgcctcagatttttagcataatctattcatcagaggcccacatttgtgagcaagtggcatgcaaggggctgtcactcacaatatacatttttaagatggaaaggtctattttgctcagatttaatttttgactcccaagagacaatgtgggactaaagtaatttatctctcaacttgctaggggatgtttgaaatttcagtaagcagcagtattatattagcatggaccatttgggcaaatttgtttcaaggagataataaataactaaactgcatggttaaaaatcagaaagaaaacaatttgttcttgtcatctggtggcgcttaaattatgaaaaatagctctccaaaggtttaatccctgaatctagtttgaagctgttgctgactttattctatcatactgcacataatgccttgaaatccactgaaaacctgtgtatttgagtgtgaaaccttccaagatgatgttgtttaataatttgcataaagacatttaggctgaaggataatagagaaacaagattactctattctatcatttgttcccatggtaattagtttatatgccatagttttaattaaagtattaaatgatactggtataactgtactttctagagaagggactgagggaatttttagtgataagacagggaaatgattaagaaagaaacacatatgctcaaactgatcaacagacgggcaatgtcttgactatctaaaattgttaattctcaactgttttgaaaactgagaaagctttagtttatgtggtcatgtcatccaaccataatgagatatttttcatatatacgaggtcagatccttgccacagacgagttgtagggtgaacacttgctccctgtggtcagggtgtagatattattcatcttcgtttctccaatacgtagcacggagaaggttgccaaaataattgttgaatgagtggtgtggctcccccgattgttgttgaaaccccaaaatctccctgtacaaagtctaagtgggatgggaacaggagactgggttaagggagaaagaattcagctgagactttttcctcttctcctttaattttacccacttaaggcatttaacttcatttttttttttaaatttcctcccctaattttctattagcacagaattcattttaagtaaaactcatatctataaaagcatcagaacagaatttagttgatttggtgtgaatcatcttttattcctaagaattgtcctttcccaattctgttaagattggttctggatatattgtggtgactcagtgatttgaataactcctagtgaaagactgatttagttaacatagctggacatatcttaatatatatttctaaatagcaaaaagatagctttaaatgaattgataggaaagagaatgactgcttctccaaaatatgatttttctcaaaattatagttgaaattgtttctgagccaaataattctgaaagcattcaaacaaaaatcacaaacgaataattgcaatttttttttctttttttttttttttagagacgagtcttgctctgtcgcctaggctggagtgcagtggcgtgatctcagctcactgcaagctccacctcccaggttcacgccattctcctgtctcagcctcccgaacagctgggaccacaggtgcccgccaccacgccctgccaattttttgtatttttagtagagacaggatttcaccgtgttggccaggatggtctcgatctccagaccttgtgatccacccgcctcggcctcccaaactgctgggactacaggcatgagccaccgcgcccagccaattgcaatttttttttataagaaaatatgaactgagacttggaaaatattttgatgtggtgatataaattaagtgctctttgaatatttggcatttattttaaggtcatattccatagaggtggatttggttgacagagcagatgcagagttagtttctccaactcctgatgccctgtataaatttattcttattaaaattgatcaagtgagcttttctgtttcatgaaataagggaataatgaaatgtatatgctatgaatgaaaatttggggtttgggaaagaaaagcatatttatcatatgaggtttgtaaaaatgctcctaagccaaaagcaatatcccatttattggtgaagaagaaatttagttttacggtatgggacataattggttgcaaattccactaaggtctacgttctcttcttaaaatgtgacagcctgtctaagcatgcatatttgagtaagtgctttctcattttgttgttttctataaaaagtcagttttgtttttttcattgatattttgaccatataaatgaatgatatattgagaaagaactcttttagaatggaaatgtcaaggccgggcatggtggctcacgcctgtaatcccaacactttgggatgctgaggcaggcagatcacttgaggtcaggagttcgaaaccagcctgaacaacataatgaaacaccgttaataataataataataataataataataatagccaggtgtgttggcaaatgcctgtaattccagctaggaaggctgaggcaggagaattgcttgagcccaggaggcagaatttgcagtgagccgagatcatgccattgcactccagcctgggcgatagagcgagacttcatctcaataaagaaaaaaaaaaaaaaggaaatgtcaaatacttagtaacaagaaaggagtatggatgagtatggatgtttgacctgcaatataattttataactaatatatatttgtttcttcagtttacttaaaaactcagcgtttggaattatatgcaatccagaatccagaaagccttgtacaaattcgttaacacttaactgaactttgaaatgcaccttttcaatgacagttttaaaagcaacatagagtttcagagtttagagtgctcatcattgtaccatggaccctcattctgaaagaagagataagtaacagattttgtagaatgtagtacacaaaaaagggaaacaaaaccattgggaaattctcaaataaacttagatctttttaattcttaattttacttaattttagtttcatgcatagctcttaacaggatcaaaatacttagtttatatcaatactggcacttaaaaaatcatacttgtaacccttctgacactaggtgaaatactcttaatcttagccttgatgattatttatttatattttattactaggaaatacattgactaatcattaattctagtaccatggaccaagtgtaatcctacatacatatgttgttttatgcaactgatttgtatccattattttaccaaaagagtaggagttgataggtttgagttattttttgcctttcttggcacaacagtgtgtgcatatagatattagtgagtatctgttgaaaatgacgatgttgaactgcttgaaattcaatgcagcctcaccttgttttctacgtgttcccattctgttaatataagcaagcagatggcagaaaataaagtctaaaatgaagatgaacttattcagtgctttaacttttcgtagaatccacattttaaattgaaaatcgtctcctaagtataaactgcagaggtacaagcaggatcaataaactagtaattaggtttgggtctcaggtggattcagaagattgtcttgctttgcacatgtgatgagctctgcttttttataaaaataatgctataaggtcgggcgcggtggctcacgcctgtaatcccagcactttgggaggctgaggcgggcggatcacgaggtcaggagatcaagaccatcctggctaacacagtaaaaccccatctgtactaaaaatacaaaaaattagcggggcatggtggcgggcgcctgtagtcccagctactttggaggctgaggcaggagaatggcgtgaacccaggaggtggagcttgcagtgagccgagatcgcgccactgcactccagcctgggcgacacagcgacactctgtctcaaaaaaaaaaaaaaacaaaaaaaacaaaaaaaacaaaactaatgctataagaaatgtttcaggaattagaatttttatgcatgttaaaatttttagctactgaataattcttttgaaaatcaaataatgtaaaactttagtgattctaaatgaaattcaaattcatgggtttcagtctctattatgattcatatgctgtgatatttatatcatttttggtttgtttggtcttcatggagacctatattttagagtttcagtctcgtggtatgtttctcaaacaaaaacaggcagatttctgtggtaaataaactgagaaaacacaatgtattttcctcttggagatttataatgtacagttatacattgtctctgtgaagttctgccgaaaagagacaattttaactttattatattctaaagtcatatgatcatggaatgcttttgcccacatgacatccattaatatcttgaagaagtagtgatttttgcggggagggggaaagggaatacactgagaagcactaatttagtgaacttttcccaagtaatttccgttttaaaaattgtgtattatatgtttgcttttaataaattttttttttgaggcggagtctcgctctgtcgcgcgatctcagctcactgcaagctccgcctcctgggttcatgccattctcctgcctcagcctccggagtagctgggactacaggcacccgccaccacgcccggctaatttttttttttttttttttttttagtagagacggagtttcactgtattagccaggatggtctcgatctcctgacctcatgatccacccacctcggcctcccgaagtgctgggattacaggcgtgagccaccgcgtcagcctaaaattttacagcatctatgtttttggatgtttaagaggcagggaaaaatatgtgttcacatcgtagtgagtttactacttgaagacatgtggaagatgaactatatcttcaatcagtttggaataagatagagaaatcagtctaagtggattatttttacactacatagaactagcctcagagacacaaagaataggagttttaaattcctgacagtcattttattaatccatttccatttttcctttctaacatagtttgtagccctaatttatatttatggtatttttcaggaaactgatggctagcagagtcatccatatatatttactcttgctagaacaccaatgctaattcaccactttgctagaatatgagagtattagtgtgagataatctgatattttttactatctgaattccctggtgctcatcatttcttttctgactccatgagtaaatttctgccaatattgtatagatgcacatttcctccagaatcatttcaacactctgtgtatgtatataaaaatcatggcttcaacaaagtattaagacacgtatcttacatgcttcttgaattatcctgttcattgtgtattaatatatcagtgtatatatgtgtttgtctataatttattttacttaccaatttttcacttatttttttcttgacaaatgggtctcagacttacactgggatctttttcccaatgcaagatgtaatatcactgataaacggttttaatatgttcctggaaaaatagtggctaatccttatggatcattgtggaatatattgtgaaagaaagatgacaaggagtttattttataatatgcataaaatgtattcagtatttgatacagtattgtttttattaaaatcaataaagcgttcttttttttttgtagagcaatgaagttgtctactacaatgcaaaggatgatctcgatgtgagtattaaatgttttccattaaattccaagaaaattatagtaaaatgattggccttatatagaataaattgagctagcagttttagtttttaagacaatgttagactgcatgagcaaaatactagttagatacgagataatgaagaacttttgtgatttttaacaacttattcttggcatcttcctaagtaaaaattccatgtgtttctctggatctgaaccctcactgcactttttccagaccacagtcctctgtaccaactgtgatactctggactccattagcaatattgaaaatagctatccaatcccatctacttctgtatcctggctcctgtcaccagggtcaccacgcctatctgctttgacttaaactttgcacaccagggagaaccatttacttcaactacaatatgaatgacaccccagaagctgtgcaacaacctgccctgcttgtacagtctttgaaacaaagtagttgctccatatgactttttaaataaatgactctaatgtacacatttaaatgacttgaaaacatggattattttagtgctaatcagttacttctaatattgctacatctggatagacattgaggacacatttattacttagtgttggtgaatagagttgcgaagttatctaataaaggttacacttaattttttaaaattcttgtatttgactcttagatcaaaaaaatgcctatgtatacttatttcttaagataaaattatttgttaagctcatcctatattttagttattttaagagcttggggtatttcagtaaacatagcaaacaaatataataaaagtattacatgtctttcacacatttctcatccgaatcaaaataattgtatttatatactattatatggaattttcttccagctatttaaaagaagaaaatgaaaaaatacataaaacaagtctatctggtcttaaaaaatgagaaaacacataatggcttgataatgtcacagtttcccaaattataacaaattataccaccaccatctcaaaccatactactaaccactttacacaacttattttacttagttcctacaatactgttaatgaagaaggttttattttctccagtttatagttgaagagctaagagtgttttaaaaagtattttttttcctctagacataggtggcgttcccatgacatctttcctcttgtcatgattgtatatattattttaatgatgtaggaggcttattaagtacaaactgtcaactaaaacaaaatgttttaatggtttattgatatcaaaataagtaccatttttgaagagatgtttagtttcaccattataattagcacttgatatttttaaacttatttaaaaatatatacaaaatcttcatcaaccttcctggtacataaattgcaacatttatttaatatttaatttgtaaagcgatgacaaagccttagaataaagtgaatggcattgacgtgcaatcctccaattaaggattgcataaagataatgaaaccaatactgcaaataagtatttcttctctaaactaattaaagaagttacatttatatgtgaaacagttttatttaggtttgctcattatttagaaagtaatttttattttacattgaaattggtgattttcttttgttcaagattttaacaataatatgtaaattgtcaatatgactttttagtaactatcactccagtttcaatcaatgcttcaaagttgcccatttgagcatatatgtccactacaagtggaaaagtgcacgtgttactatttgtaatacttcagttgttctaatattgttacatagtttgccttcactaatgttcattcaaatgtttaaatcaaagtctcttgagagagaaaaaaatgtgtaagtgaacttattaaacttgtcttgtttttcccattttctcatctaaaaaaatagtatctactactactgtgggttatatatttatgcttaggataaggattccttctctgttttctgccatgaggtgaaatttagcaaattaaagccttataaatagtaaaatgtccacatttaaatttaaaacttaaaactatgatggtcagcatttgaagaaaactcaattgctttatatacaaacaataacgttatcagaataattcgcaaagagtgttgtttcgtgcaaactgaactagaataggaatcagaataattcatgccctaatccagccctaaaattatagtcatcctagggctttaacacctattaaaatttgaactgttattctctcatctaagacatgatacagatgaataggtgatccataacgttcatttcagttctggatattcttagattctaatgaaaatatatacttatacataaagaatatacttaaatggataaagaatatgaccacattatagaatttaatagtcaaaaggagggaagaagatggcattcatgacttttaccctactataagcatgttggttttttgttacatttttaatattttctcatgaacatatatgtttacttatttgcataattctttttttttttccgagacagactctcgctctgtcgcccaggctggagtacagtggtgcgatctcggttcactgcaagctccacctcctgggttcacgccattctcctgccacagcctcctgagtagctgggactacaggcgcccgccaccatgcccagctaattttttgtattttttagtagagaaggggtttcaccgtgttagccaggatggtctcgatctcctgacctcctgatccacccgcttcggcctcccaaagtgctgggattacaggcgtgagccaccgtgcccggccctgcatgattctttaagtacacaagttattaagtggcataatcattttttatcttgggaaatagttgttggatcattcttttgagctgatataacacaattcatttaactccacttctaccttggagtttaattttcctttgtgagtattcacataaatatcagtacatctttacacataaatattattcttcaaagttttaaacttatttttaggatagattcccaaaagtggtaatttttgacattttaatgaattttgatacatagtgcgatatcacttacaaaaaggaccagaccaagttctaccatcattaaggtacagagacattatttcctcacaggctgctcagcattatattaaaagataatctaacacattcaaatagtttttcactgttttgattacttgtcttccagtattcagattttgccctcaacatgggaaacccatgttttttcaggctcactgacttgtgaaagtttctgagccaaagtgaggttgtttacatatctgtgaaatctgtatattaatatggatttcataataatgggtaaaatattattttacacaagtctgaatattgctgatatacgtaagcagtatgtaaatatttattgcatttggccatgtttaaggctgtcattgctcaagtaaagcaagaatgtaatttgttaagagaaaaaatgggagaaatcacatgaggaaatataattctacttgtagaatgctttataaaataaaaaaccaataaattatcatgtcaaatcaacctgagtgtaaaatacaaagttgatccttgtgacatcattcagttttctgtatttggaatatttcatgtgaatttttctgagaatttgtaaagaactatatgataatttattgtatactgaaaatttttcattggacaagctcagagtgctttagaacataatgctaatgctcttataagatcttaaaccttgaatcaaaacaaattatgttgtattgattagtatatcagtttgtctgttagagagatacctaaagtaaaagtggcctaaattagacagaagttgattcctctctaggaacattctggatacactggctaatacagcaactccctgtctttccagccctcaaggttcttctccccattctctgctttcctcagtgtagctcttccatgttgtgctccaagatcggtgttccaatatccatgattctttttgcgttctagattagaggagagaggcaagtgacaatgggagacatgccctttgcctttaggggcatgtctcagagtttgcatacatcacttctatgtgtgcccattgtccacaacttagtgaccagccttgccttgttgcaagaggatatggagtacttttcctcccaacccttgacccatgtgtacatacccaactaacatgtagagttacattactaaagagagaagggatagtaattgagagatcattaattagcagtttctgcacatatcttcaatttgttcttcttgacatattaaagttagtgcaaacactctactcattcatctgagtgactattatcttttaaatataatcaaaccctttgggggagataatttttctatagtaaaatgaatataaaattgggtgctgtactgagttttttctaatatctcctaatgcattttgataactaatgatcaaattgttttctgcaatagaaatatttactatattacagtgaaagtcaagaactgtaaatacatgttgtactttgatattctagttaacaagtttcagtatttacattttttttaaaaaaagattgttacttatctcatgaagttagactcctatggatgatgaaatttactcaccctcaccaaaagttttgcagtacagggtggatttaattggatcttttgtttacaactttatatatgcgttggctggtattttatatatcaggtgttcacaaatcatatcatcacattgtttttgtttgaatttggctactatcactgttctttgctctcacttttatacatgctagtttagctatgtatttttattgttcaaattctacaatgtcatattcttcattaaaaatttgtcatttgagattataaaatgtaactttacaatctcatacgtctacatcaactaataaaacagtggggctaattggcatactaactgctgggataacattattaataaatttagtcctcagtatgtttcaatggggattaatatccgagggctgttgaaagaaattatggataaattaaatttacccgagtttatttgtataaagaatgattcatgaatcaggcagtactcaaaattaggacagagccccacccagcaacatggccaggcagtatttatagacagacaaaggaagtgatgtgtagaaacagcttgattggttatagctggacatttaccttacttgggcatggtgatagctgggcatttaccttacttgggcatatgtagcatttgccttctgtggacataatctgatcagtgggcagcctgtgattggctgaaactcagctgctatgattagctgagactcagttattagttacaagaatatacttttaaagtaggttgcagtttgttaacatactaagttaggctgcagtttactgtaaagaaattcaaaatacaaatgtaaccttaggacaaatttagtttataagagctggccggcgcggtggctcatgcctgtaatcccagcactttgggaggctgaggcaggcagatcacgaggtcaagagatcgagaccatcctggctaacacagtgaaaccctgtctctactaaaaaatatttttttaaaatttagccaggcatgatggcgggcgcctgtagtctcagctacttgggaggctgaggcaggagagtagcgtgaacccgggaggtggagcttgcagtgagccgagattgtgccactgcactccagcctgggcaacagagcgagactctgtctcaaaaaaaaaaaaaaaaaaaaaaagacaaaaacaacaacaaaaaaaacaagcactaaataaagtttctattttaaatattatacctcctgggtataactaaaagattataaatcctgaggctctggttattttaactttttcaccagttctgctggagatgatttgttttccaactcctaagactagtagattagtgatcatttccaggatttcctagtactcatatcaatcatttcctttcactgctctaatacaatcatctaagtttagacattggtctcaaatatgttcttaagagctattgaaattatctcattttatgattataaattttaaatgcatttaattatgatacattattatataaatttataaacattatattcatatatctttttccattgtcaagatctttgtcacttattactgactctttttttgatgtttaataccgtgcagaaactttaccagtaacttccctaagcggaacatataatgtttggcagtgaaatgaaagtttctccttcttgaaggcacagccaatctttgtgaattattatcttagggtccctcaagagtataagttcccagagagcagctcttatgcacttatagcagctgatgtaactcttacaatatcgagtacacattgtaatcactcaaactttctttcccaataaatctaagttcatattaaagcttcatttcacacaactgtaaaaggaatgttctgaagtatagtttaagaacacgtcatagttatattctagaattacttccccatactttaatttttagagagatcctttccctactatcccaaccttagtccagacttgtgtaggtctctataatctagaggattggcaatgaaatacataccttgaagaaaacgcttgccctattgttgaccagtggcaggaccaaatgttttatatcattagcacttctgtagttacaaatatgacagcaccaaggacaaacacttggggaagaaagactacttcccagtcttgagactagataggcctttcttcatttaagactaataaagtaaaatccagtcaatggagaaatccatgagatactcagtaacagtaaagtaagtattaaagacacagaggaaaattcttctctaagatagtattacttcagatatgtcaggcagaaaaacaacattgaatatatgcttactgtccccaaagaaagagtcaatgatctataaaaagtagactaaaaccatcaaaatgaaaaccactgaaacaaaattctcaatggagaaactaacaaatttgacaatgtgaattgtttatcaataatcctcagaataagtttgagaagtactcttcaaatgccagaaaagtaaaaaatgtgggaacaaagttaataaatatgaaggtcagaattcataggtgtattcataagtcctgtcttcccagagatcaagtcaaagcacatgtatcagatataatcatcaaggatttaatggaaggaaacattcaggtctgccaagaaatctgtatataattgtagatttggaaggcctgcagtgtttcagacaaagatttttaaaagtcaagaacatttataccaaaaacttgctcaaggatattcaagaggagatttctagtaggcagctaagtatttagtttggttgcttaggagagtggcctagaatagagttttatgtttagcttatgaggggaatttgaaaacaagtggctgaaatttcctgagcaagtgtgaagttacatatatagtaaggccagattcatctacagataaattttggcatgcttacacaaagctaaaaacaaaatgaatttgaatacctttggatataacatattctgcagcctgctgtaatgccactactccttattgtctactttcagcctgcttcacacatctacacaacattaaaaaaaataccttaagacaatacaagatagactcctcagaacaccagcattcaggggaacgtgggggcaggggaggggagtatgggatatgagtagagatgaagtagtagcagccttcataatagaagtaaatcatacaaagaaggtcatgagattagtacatgttggcatcaggacaaaatttggaatttcctgatttctactgttctttcgtgtttattaggctggtgtagcaccaggatcatgtttgtgtagaaagaaggatacattcgagtgtaatctattgattttgttcattataatgatgatgcatggcctccaaggtaaaacaagtatttaaagttgatcaatgcttcctttagagtgaaagctttctattagctgcatccgaattagtcagtttgtgggaaagtttatgctcttcaaggactctggtataagacaattcctcaagggcattttatagttatctacgttcctccacttagagcaatgctatttatattcaccttgtggctataaaataaatacagccaggtttagctaaagcagtggctgaaattaagtatagaattaatgtctccttacgattgtataatataaaaattatggctttagtcatttaaacagattttcctcttgaaacttaaaaacacaggtagcggccaggcgttgtggtgcacacctgtaatcccagcacttcaggaggctgaggcaggcagaacacttgagcccaggagtttaagaccagcctgggcaatatggtgacaccctgtctctacaaaaaaaaaaaaaactaaaattagctgggcatggtggggtgcacctgtagtcccagctacttgggaggctgaggtgggaagattgcttgagcccagtaggtcggggctgcagtgagctgatattgtgccactgcactccagccagggtgacagtgagaccctgtctcaaaaacaaacaaaaaacctcagaaaacaaaacaaactatgcaggtataactgggataaattattggatgagccgtgattctcatggaaggatagaaggcacatatggccttactggatatgtaagaaaatctttgctgtgtccagttaacttatcctagataatattaacatgactaatcatgctaattacctgatcatgataccatacaattcctccaatcaagtgctttacttaaaaacccaatttaaataataactctctttaaaccttccttgtttttttgtaggtagcaaatggtagtccttcctatgagcgttctaagcaacttgtaatgcatttttggctttaatggtataataccttatacaatagaatatgtgtacagggtttgatcttctctactaaagttttagtgatttgaggtagaaataatatttagtttattttatagtatacagtaattgctgaaataatgcttgttaaatttgtatacccatattttcatagtgtttgtgaagatgtgttcaccttttaaagtggtgctatattgtaagcgtggtggaaatgaaaatgttaattttgcttcaaggttagtggaagcaaaatgaagagaggaaataataaagctagcttttactatggatgatatttgaattaatgtttaagatagacatttgcttccttaatttcatctaatgggattggatgcagatgagagtggcagtggacagtgttgtctcatcttctctgttttgtccctggggacagccatcaggactaagaggagagttaaaacagacaatgtagtttccctaggtccaaaattaattgaaattggagaataagcagtgcagttagaatatttgtctgtaattactacaagtgatgtaagtatcaagatatttggtttcaagtgtgaatatttgtgaaacatgaactcaggcgtattatattcttccatcagaaccaagttcttttaacaaaacaccaggggttcagtctatgtcccattgcttgatgcacagaaagccagcccctgagacaaagaatattgccagggaagaaagctttatttgggtgttgcagctgaggagatgggagataagtctcaaatctgtctactcaactgactaaaattggaggtttatatagcatgaaaggaatgtagctatatgcaggaaaaacaggaattaggagagggtctggtgtctcattgtctgaatgtggtgatttggtgagtttcagttccttggaggcctgatggttggtttcctgagaaaggaattcagagaagataaatacaagtttcaagctttaagaccagctgggtcaatttttgtgtttattcgaaaacactgcagacattaattctttgaggaaattgggcggatttcactttcttattctacatatagtattaataaaaaaaagttgagttttatttccaaagagcctacatcattcaaatgagcataatgtttcaatgtaagattatttttatcaggaaaaagattttaaatatacagaagagagaaatagtataatgaatcatgtcatctgttgcttaagtcttttaagatagagacaatgttttatttccaaatacttctacatgaaactctatttttgtttcttctaaataacaaggcatacatgtacaattgctgtatgccttgttatacagtagaggcaatagagtgtgataattgagattatatactggagtgctagctagattcaaatcttagctctgccatttctgggtgatattggcaagatcacataatctctctgctttttagttatttggtctttaaaatggaggtgatagtaatagcaacctcagttattataaagattagattaacacatataaaacatacagaccatttcctggatcatagagggcagtctagaaatgttaatgaatgtaattgtgaaaaacattaattattaatatcattacaacttaagtggaagtgatcttagcatcaaatggagcgtgtttgtgtatctgaatgtgttaataatgaaagggcattatattgagatatttttcattttattgtcatgaatttaatctttgtatgaaaaccttaagataatgcatgcacaaaatacaaagcaaagttaaatgctcaaaacacattttaaaaatgcaaacacaaacggggaagattgttttcatatcattataggtttcatatgttcaattttattttttaattttagagacagggtctcactatgttgttcagactggcctcaaactcctgcctcaaggtatcctcccacctcggcctcctgagtagctggcactacgggcacttgccatcatttctggctctgtttattcagattttaaagaaaaagtagatgttaaaataaactgaggggaaaaaaaagctagcaatgtaacaattatctatgaaaacccaaattcaagttatcattagttttgaaatttatttggattcctagtttaggtttcaaaagacatctgacccaataagtcattaaattccctgaagattagtgaagcaaattcctcagaagacttcagttgtgccagcaaactgtgctattttcttaattcccagagtaagcaaaaagaaagcagatcattacaaagccttattaacccaattccaagatctgtctaaaattcaaatgaagtaagttcaacctagaattcccatgtcattaaattgagttgatttatttgctcctttttattttattgatcatgttcaaaatttctcctgtctgggacatttggctagtctgctgaattcccttgcatatttacgttgctatttattttcctcttagcagcagagtcttgtctacattaaaattaattccaacataatctcctatctaaatgtctttttcagtgcccaatctttaatgattatattttactttatagcaataaataaacctggttctagaataagctagtagggatatgcatcaaacagcaatgaaatctaattattaaagaaaaaggaaaaatctaggtttcttttctagcattttttttttaaaaagctgtcttatagtatgtaacttttattttacacttttaggtatcaaacattgatgaagtctaattattgaagaaagaatcagagtctaggtgttaccggtggagggtgtccaggtccttggcattttgaagaaagaactggataaaatgcagaaagcaatgaaagaaaaacacagatttattgaaacaaaagtacactccacagagtaggagcgggcttgagcaagtggatcaagagctccagttatagaattttctggagtttaaatacactctagaggtttcatgttgcttacttggtttacactctgtgtaaatgaagtagaggcccacaaccattctgattggttgcagaaagtgaccaatcagaggctgaaagtgaagttacagaagaagatttggcctgcagtcagtctgattggctgctgaaggggaccaattagatgctgaagtgaagttacaaagttacactcctatgcaaataaagactgtgaccagtctgattggttgtgggaggggaccaatcagaggtactttccattttgcctctgccctgggaagagggtggagggttttgcaaaggaagtagtctgtgatccttttgttacttgggtgtggaaagttgagttttccttttgatttagttctagaaaatcagtatgaattggccttaggttccctgcctctaaaccctattctcctgcctcataggtttcttttctaacatttaaaaaattaccttacagtttgcaatctttatttcaatttttgatgttggccaatattgaatccttgaataggatggcatacaggtagaatattaattgctttgtatccataattgctttggttctttttgcttctaaaataaatggtttaaatatttttgatgtgatacgtttggattgggtaataatagctagcatatattatatatacatatatatactgattgtatgatatatgcttatatacatatgcttattctctactaagtggtagcatttaaagcatactacctagtctatttactacctagtatagaataagtatgtataatatatactagctattactataactttatgtatcatttacaattcacgagaaccctttgtggcacatatattattttatttttcaggcaaaacaagtaaaatttaatgagcttaagctgcttgtccagtgctacacattttggatttgtcagagtagggaagtgaatgcagtgcagtctgtatgatccagagctggaacactgtgtcaccatgctgtgctgcctgggcagtgggcacctatgaggaagaagagggcctgtgaaggagctgctgtaaattgagacttaagggtaaaattttggagacagttttgatttaaaatttgaatttattacatctatccattattctctccgtatttaattttgatgcatttggcttatatttcatccaactaattttatcattgacagttgtgaggttacagtgttcttgcagtaggcaaaataaaacgtgggtgatgtataagcttgttaaactttgagtcctaagtttctgctgatctgatccagtattcccagtgatgtttaccatgaatatcttaaaattaatgtgtgcatctctgtatggaatgtagccatctcaggaatcactggggggagaaactataaaaccaataaaaaggtagactagactcagtgtcttctaagaattctgccttatgtttttggggctgctttccaaaatttttcaagcctgtcctgatatatttttaatgctttacacacttgggcacatgctccttttgcaaagatggtttaaacatgggttcccagtcgtcctggattagtggcatttatggtgggaacctggagtcctactgtgtgatctcttaaattagatcttagttgtatgactttagccagtctttgcctcaggtatcaagagaatatcattgatcttcgtacctttcaaggtggtaggttgttttaaacctcatttgccctggcaatattttgaaaagtatatttgtgtatcataatataaaaaattcttttaattttttagaagtagaatgacttcatttaaaacatttccttttataatataatgcatgctactacatggtttccatggggagtgctatgttgaactttcagactctgtaaaaatcacatagtgccttttacaatccttgagcagaagataaatatcactctcttcccaaaatataggttacatatttagatataatgtgtagatatgggtatacttttgtagcactgtattacatccctttctgatgctggatatttgaaaacttcatactacatatggaatttaaatcagcctccaactcttttccatcatactcaactgtattgtattgctaatggctcgccttactccctgctaggtcttgtgataggcaattcatgggcattcatgcaaactaaatttattcatcatgcaaactaaaattacatcagttttatttcaaggatgtcctcaggttctgtatttcagatcttttgaatgcatcattataatcctcatcagcgactttaatcttatttgaagaatgtcaattttgtcttttaaatttaataaacaagttattgcagggatcagtattgcattttaacttaatttagttctaatttatctttcactgtcatttggaaaatttatatattctttgttttaatattccctacagtgttttttaactttctttttgttactgctcaatttcagctgctttgtgatttcacttttccccaaaatctacatatctcagactgtttcttctcttttatacatcataattattagtagaataatacatgaagactttacactgaatctaatctttaaaaactagaattgtttcttcacctttctttcgccactgatgttataaatttacttttcatgttaattttaaaactttcttttcttagtatgttaaataaattgcttctgaagaatcaatgctacagtttttccagagtaaatctaaggagttacaatatttttattacctgaagaatgggcataatcttctgaatccataaaataatttgttcttcatcaaatatattacctaagctcatatgtttttttgcaagaacaatatttctattcattaaatacataatttcaaaattttattttttgttatgattcagtaaaagtacaaatattatgtgtaagtccttaagtgcatattcagtgtcatccaactcatacactttctaaatctattcatctaccaaatacttctctaagtcataggagaaaatagcagcttaaatcaatgaaatcagaaggctcagttatgttcttattgtcattgtactagattcatcatttaatattcaacctggccttccaacttgacttagaacaactgactggatgaaagttccacacctctttctattcattctttatttgggcatcatcacctgcaattctgttgagtcttcattctcattgatccaagagatttaccaaaaatgaagcttttcaagatgggcgtggtggctcacacctgtaatctcagcaactcaggaggctgaggcaggaggattatttgaggccaggagtttgagaccagcctggacagcatagcaagacactggctctgaacaatagaaattaaaaaacctaggtgggtatgatggaatgcacctgtagtcccagcagctctggaggctgaggtaggtaggaggttggcaactcaagggtgtagtgagccatgattgtgccactgtactccaggctggggaagagagcaagatcctgattcaaaacaaaacaaacaaacaaacaaaaaatcacaaggcttttcctctgtgtgagtcagacctggtaacaatctttaattagcagagcagcacaggatgcttaaattccaatgctgaactagccataacagagtaatgtaatactgtatattaaaaagtaatgtttaaagtaatgtttaaacattcttttttttttttttttttgagatagagtctcgctctgtcacccagactggagtgcagtggtgcaatcttggttcactgcaacctctgcctcccaggttcaagtgattctcctgcctcagcctcccgagtagctgggactacaggcatgtgccaccacactcggctaatttttgtattattagtacagacaggttttcaccatgttgaccaggctggtctcaaactcctgacctcgtgatccacctgccttggcctcccaaagtgccagaattacaagtgtgagccaccatgcctggcctaaactttactttttaatccatagtgttgatccagtatcccagtatgccagaatattcagacttgatgcctgtatgaaagtccaccttaaatataacacatcctatctttgataatgctttacattggaccgtgatgccatgccttaaggcatattacatatccaaaattgatattgaggatagtaatcgagactttaaaaaattctaaaatcagtaatatctgtattgtaaaagctgcaagccctaatgtaaataacaactgtacaaaaactacaaaaaaccaggatgtatttagagattgaaatttgaaaatatacgtacatacatacatattggagaattgcatgcaaggcttgtttcatcacacaggatcctacacacatgcacacacacacacagacacacgtgcgtgcgtgcacagtctcattctgtcacccaggctagagtggagtagcataattatagctcattgcagcctcaaactcctgggctcaaggccctcatgtctcagcctcctgaatagctggaaataataggaacataccacgatgccaggctcatttttaaattttttgtagagatgagggcctcactatgttgtccaggatgttcttgaactcctggcctgaagtgattgtccagcctgggcctcccaaagtgctgggattacaggcatgagccactggacctagccaagactgttgatctaactcctttactagtgagatagaaatacaaattgtgatacttccatagagagttttagtgagccattttattctatatcaactaattattttacaactttgtggcacacaaaaataatacagaactggggacataaacgtagccatagtatgattgcaagcaaagtttatcagtttgcaaatctgaattgtgcaaaatagttaagtaaatttccattgcaatttaggtaaaatatatagactttaatttttgaatattttgctataagtaggaatattttttaagttaacatgaaaaagaacaaaatattaaaaatcaatgctttttataaatatcagttctaagggtgagacaaatatgttaaatttgcaagagctttttgtacctgtcaaagaattatcattatgactttccaaattaaatttgctaatatgcactggttgtaaaattgaatgacctcctcatccaacattagcttgtatctctgtctctgagtgatctaatctattatttaatagctgaaattatattgagaagaatagtctgagaattatgcatttcatgtgtcagtttcgttttatcaaatgcatttgaatatatttcagaatccacttgctcattttctctgtacacatttgtatatggtggtctgtagacttcagaagatatattttgaaaagaaaacactggaaggagacatagatgttctttcttgtatgtgttctgaagaactggaattctttgtttcagagggagaatttatttgaaatagttaattactacatgagacattctgtgttaagtagcctttttcataaaagtcaggtcctttgtatataatatttactgtatttcaattaaaaatatactgccataatatataaagataagtaaagacatggagtatgatggtataaggaacagtagtttccagtagcttaaagataataaatgagttcaattgagaaattctcatctttttatgaagttattttaatttatataaactagaaaaggagaaccatggaaatagcactattattcttttttaaaatatgtttaacaattgtaccttaaggagtcttgatacatgattttacaagttgagaagtacgttattattttaaagttatttctaaaagccatttatatggttatttaaaagagcaagagcctccataagatgaatttaaaactgctaattgttaagtgtgagaggattcagaggaaacagaagtaatttttatgtaagacaagctttataatattaatagaaaagacttaaaccttaatagtttattcttatcacaaatataatatattctcattgtattattggaaaaaccagaaagcacaagttatttcttaaaattgcaaagccaggaataatactggtaacacttgctatgtatacatccattcatttctccctctacctgtttctacccaaaacaaataggattttttctcttttcacttttacttaactcgtaatttttaaacttcatatcatttaaaaacaaatacagttagggtagagttaaaacctgttttgactgaacaaaaaaagtttaacacaaatatcaaaaaatgttatagatgcattttggataaatgaatgaaattcttagtttgttaccaggggaaggcaaccaggtaattcagtatcaaaagtatagttccaatagatagaaaattaatctttgacttgagactcctgaggggttttcttgaatcattattgattggatcttcattcctgcctcaagagtcaaattggttgaaattaggatttaattgtatttagagttagaatagatcgcttctttcctagcatactttcttttttaaaacaaaaattgatatacctgaaaaacatgcaaaaagcaagaggatgagatttaaataatccttcattgccatattatttctgtcacgtgtaccattatttgtcaaagaatcatcttcaactgcacaatataaatttagttaaataaattgtgaaatttatttcaagtggataatattagttaggttgtatttaaaggcacctctctagtttcttattattttatttgtctgtttgtttgtttgtttatttatttgaggcagggtctcactttgttgcccaggctagagtgtggtgatgtgatcatggctcactgcagccttaacctcccatgcacaagcgatcttttgacctaaagcctcctgtgactacaggcctgtgctgccatgtccagctaattttctgttatttgtcatagagacaagggtttgccgtgttgcctgggctagtctagaactcctgggctcaagtgatctgcccccctcttcctcccaaagtgctgggattacaggcgtgagccactgggcctggcctatccaattctttaagtttacatcttaataagtattatatgtgtggaagtctggtctccctcgtcccccaaagatgatcctgaatgactccaacattgaggaaatcaggagagtggttagttataatgtgaataatacaataaagatatactgtgagtgctaatacctgaatggaaatttgtgtatccaatgctatcaaggtactatattttaaacaattgttgtagatttattttttgaaaaatatgcatttggcaagtaaagaagtgcatgtgaaaatatttatgttagcaaaaattgtaatattctgtttattctttttctatatagcctgagaaaaatgacagtgagccaggcagccagaggataaaacctgttttcattgaagatgctaattttggacgacaaatatcttatcagcacgcagcagtccatattcctactgacatctatgagggctgtaagtaaaagaatgttaacatctgttggaataccatgctctcgcctgtcttatgtttcccatgtttgagggggaaaaaaaagagcaaatgtgacattgttttgtttgtcatataagagtctgtggtaaactctgatttatgtgaaagaatcaatctgattttcatgaacagtttatgtgagtataccctcactaaacgaatatttgtaggacagcctgcatccatggagtggtccttctaacttaatgtttggtaaataattctgctttcccagttgccacccataacttacaaagtatatagatatatttgtcaaaagccaaaactgtgcagctgtattatacacacatgcaaaaatattcttgcataaatgggtaaagggagaaaattgtatgtttcagattctttccagttcttatgacttctcatgtctgtcagtctctctctctttttccctcccggtctgtgtttttctgccttaccctaggatataggtaaagagtaccttcctctcaatgtattgtgggcttccagccaaaagaagtgcttgggtaaaaggaagagaccttaaaaactagaaaagctgtgactggaaatattggttggagaaggcttccctgtgaaaaagggatggggtaaaaaaagtgtttaggaaaatagtggcggaagcttgcgcaggtgttgttttttagagacacgctttgcattaatcagagcagagcctgagaattctaactaggaattttccaaaagacagctctatcatgtctgagaatgaactgtgaccagaaacagggtatttgttcagtcatatccctggtcttccatattatttattctttaacccatccctccaccccatcctgcacctcgttccctgccttctcacatagtaaagggtaaggggaaagaactgcttgcgattgtaaagaacgtgtttcttgtattcctcttaattgagacgcggtagagtgtatttggaatccagattatccagatggcctgggttctggaaccagactacctgtgtccaaatttaaattttagcagtattatttcctctggcaaatccttcaaatttctgagtaggcattttctcatctgtaaaatggagataagattagtatcctgaaatgtcctttgaggataaagcaagtttaatgtatttaaattctcataatagtgccaggctcatagtaagtgctatgtaagtgtttgttgttgttattatttacagttaaagtttatttagactcacaagattaagggactcacattgtatatgagctttttttttttattcactttgagattattggttttaaaaacaatttttaatgcatatatgattctttttattataaattttatctttgatcaaattattttattttgtttctccttttaagtgttttaaaagtaccactgttttcatcctatcaattctttgattttaaacctataattacatataataatagaaacgttgtatgtgtatatatatgtgtgtgtgtgtatagatatagtttctttttacatgagccttaaacataatttaacttctttacaatacaactgagactattaattccaagccctttttaaaatcacttgagatttggattcatatattaatattttttctttgaccattgtattatttttctgtagttacttttgatatttgtaattgtttttgtcattattctaactgttcagacaatgctaagctatatggttatgtttctcaatttttgaataatatattttccactttagtttcagatctatcacctgttgtttgttggatatgttaacaaaataataatctccttctgtatctttctattgaattccaattggaagaaaaactggctgggtatagaagctttgagtcaaaatattttttgtcagtactctgtacatcatggcactgcttttcaacctgcgttactctgttgaagaaaactgaagccaacttgaatgttgttcatttattagaaatcttttatgattgggttttgtattgttgatatctgggaggctttttatttctaaatttagtaatttataaatgtccacaagatattttaagtcagtgattttctaatagctttgctctatgaacattttgtttacaacatgtatttacgtagaagactgatgtgtaaaagaagttaaagccaaaaccagtgtgcctgaaataaatgtggtgtggccagaacactagctgctttctctttacttccttttcttctgtttctttttttttttttttttttcttctgggacggagtctcactcccttgcccaggctgaagtgtagtggtacaatctcagctcactgcaacctctgcctcccagcttcaagcaattatcctgcttcagcctcctgagtagctaggattacaggcatgcaccaccatgcccggctaattttttttgtttgtttttttgtatttagtagagacagggtttcaccatgttggccaggctgatctcaaactcctgacctcgtgatccacccgccttggcctcctaaagtgctgggattaaaggcgtgagcccccacgccggccctctttactttaatgttctctgtctagtattggtagtcaagacagattgtctggacaagtttataggttattgtttggttatatgtgagccagaattgtccacaggaggcagtaagatacttactttgcattagaatctgcattctcttactcttttgcttcctttactgagttgaaatcactttataacttaagcatccatctgttgtatgctagaacaaatatgaaatctgactcacaaatttgaacgtaaatttttaaaaaatttttttaaaaatgtttacataggcatacatatatcttagtatgctacaatttacatacacaaattaatttgtgtaaacaatgtttttctttccaatttaaaataaactatttgtaaatagctacagataattttaatagtctcagagaatacaacttaacattttgagaatcaataaaatatttaatatgttttcagaagtcataggcattctttgggatatgtcataattaaaagaagctctgtctttggattatttatttagtcccattcatcttaatattggcatcttcatctttgctgaaatctcatcagtaagactctaacctttcctggcctgtactcctttaaaattcatgtccaatgttataagctgcatgaataaatgacaggaatgaaatcagaaatgtccacaagatctggaaaatttaataattaccagtattcttcatgtggtgtgtgggaacatatccgatttagaggattgttctcggcttctgagtttaatgaatatgaaaatgcactttaattgaaggcttaactgaaggaaacagcctttttcattttaagacagttgtgtagctacactctcataagaaacctcgtgttctaatttcacaaagatgattactttttaaagtcccttgaattgaaatgtgattatttctgctcaatgatatatttaaagttttagagtactgtatttaattagagccccatctcaaaatctccatttttgagaatttcactggttgctccttttcttttagaggacacccaaaccatacttaattttcagatctaatttatctgcttagaattatacaagacaagcatataacttagtaaaaacaagggctgaatattctgagttaatttgtttttaatctcagaactttattaatttttgaatcactttagactcaatgtagggctgtcttcatagaatattgtataattattttaaatggaaatttgtattgatagttctttgtataattatatttctataagaataacattaatgagggaaaataataggaagaaaccccaacttgcataaagctttcagggaccagatacttttgtccttatacttaccctataatttaagtaaggcaattattatttacgttttagaagtaaaaatacctaacatacttttatcatgaagatatcttcattttgataaaagaagacaattttcatgagttgtattatcttttgatgtctcatatgctttactaaaagtgcttgatttttgtaatttaagctaataatcactgacattatccttgtaacttatcttgatattcaattgtgttatcttaaaagatatagccgctgtatcttagatgacatcagtgtcaaaattgcagaggaaaaaggtgcttgcagtctttctggacaattgcataatctcctgtaaattttagtaactaatctgttccaacaaggtccaccacttgctaatagtttacatttagctgttgtaaacagcccattttgttgttactccaagaaccagtgtgggtagtatacctttaacagagtaaaaaagttagtattcaagttgactggcatgctgtacataaatcaggctaaatccatagatctgatagttgtataaaaggcagaggaaaacaatgcttctttaaggtgtttggtgttcttgggcaaaaggcttgattcagatggaatagttgtgctctaaagtctgtatctgcatatttttgagaaaattatagtctcagtgaaaatacttcagtggagtgatactagcttgtcatactgcgtcatcaaatatattttgtaagaggggaaacttgttcatggttttggtagaccattcagttctggtgtataatgttattctttgtaattagctttgaaataatgagaagacgtgagagcaactttaaaatactgaaattaaagagtgaaattattctttggataacagatgatttaaaggaaatgcaatccacgagagatatatgattatttgatgttacttacaatgattaatatgtgtagggtagattacttaggatgtaattggtttataaccaaagtggattttttaaaagttaatgaaaaatgatattaggcagaaactatagagttaatatttattttttcttataatgattttgtttctgaaatattatcttctttcaaactatattgattatagtagttgatatatattagttaacttggaagtgtacaatattttgacctgtatttggcatattttatttaacaaatattttgatttattgatggattagtttaaaaaacaatatgttagaaagtaaatcacatttgttctgtgatttcaataacaaaataatatggattatatttatatgtgttaagaaaaatatctattttgtaattataccttgataaaaactgttactatcttttattggaatagaaagctcctcctggtgtggtggctcatgcctgtaatcccagcactttgggagaccaaagtgggcggatcgattgagcccaggagttagggactggcctgggcaacatagtgaaactctgtctctctaaacaaattttaaaaacagccttgggtgctggcatgcgcctatagtcccagctccttggaaggcagaggttggaggttcatgtgagcccaggaggcagaggtttcagtgagttatgattgtgccactgcactccagtctgggtgacagagtgagaccctgtctcaaaaaaaaaaaaaaaaaaaaatatatatatatatatacacacatatatacacatatatgaatatatatatacatatatacacatatatgaatatatatatacatatatacacatatatatgaatatatatacgtgtatgcgtatatacacgtatatatatatatatatatatacccagacatatatatatgtgtgtgtatatatatatatcaaggaaaagttcatcataactaggaaaatagcttttttagacatggtattaccatttaattacctcagaagcagtcaatcatcaagtgaaattttattaattaaaactaacttcaaatatatatgtatgttaaaatatatatcataggaatgaaaaatattaaatgttctctttattttgcctttaacacatttcttcatttagcaaatacttattaaggacctagtatgtcatgtacttttccagataatgggaatatagcactgactaaatggtcaaaattctctgtactcatggagcctgcattctattggaggggagtggagtgtaaaacaaacaattaaaataatagtgtatatcgtagtgtaatgagtgctctcgataaaaatagagaagaggttaatgatagtgcctgggttaagagagaagagtgaaattttataatgggtagatagagaaggccttgtggctaaggcaattttgtaattgaagtctgtagtttgtgagcaagtgagccataaaaatcacctgtgtaagaaggctgtggccatggaaacagaaaactcaaagatcttcaggcaggagcatggtgggctcataatcagcagggagaccattgtggccagagcagagttagcaagcgaacggggagcaggggtagcagcagacgccatgtcagccacagccctatggacgattgcaaagactctgatatttactttgagattgtcttaattatctcagacagataggctaaaataacagacgtgtatttcttacagttttggaggctaggaagtccaagatcgaggtgcaggttggtgcccagtaagaattttcttcctgggtcttctcagtgtgtcctcacatgacctcttctgcactagcagagagagcgagcaagctcttttctcatgaggccactaatcctattgtaggtgctccacactcatgacctcatggaaattacctcctaaaagccccatctcctgataatatcacattggtggttagggcttcaacatatgaattttgggagtatacaaacatccaatccataacataaatggaaagctgcgggatgttttctggaggaagaattttgtaatcttttccatctttatgaaaaagttgtggacattggatactatgttgataagaataggcataaaaggtataagaacaggaggtatgatggacaggtaggctgaaataacacatttatacaaaaaaatctgagcctccaaacgctagaattttaaacatgtacaatcctggggtaaaaaacgacgtcattcacttcatcagggtttagctatggatcatggacaagaatatagaacctaacagaagtggatgcaagtcctggctttattgctgaattacatattcaacttctttacaatcaaaggaggtgaatataccttgttagggtgcagtgaggattgcatgcagtaagtaatgcaaggaatctatctaataggaaatgcttctgtcttcctatttttaaatccccaaatagcaaagttaagatgaataaaacagaacaatttttctcactaactcaaaatattaccatgttcctccaatctaaaccataccaaacttgtttcatgaacaacagtcaaataattccaaaaaatatttttttatttgatagtttcattgttaccatggtagaaatcaaaacaggctttcaaccaattgttctaaattttacaggatgctgactcattcttgttaaaattgctgattagtctaacaggacatgacttacatgagctgccatatatgaatatcctcaccgtgacaaatttcctaacatatctagtgctcagatgaagagctgaaaaatccactacacttccaacccactggtatttttcagggtaattgttttctatgcttggtatttgtcacaagtgtgaatctggatcacaatagaatcataaaagagttttcatcagtaggaccttcttaagttttgtgtttattgattttttaaaaccagataatttgcaaaaaaaagggttctttaattctggaaagtacatcattatatataatatatagagttgtatgttaaatgactaaaaaagtgaatgtttttaaagaactttcagtaaaatgttgtcatggttctgatattagcagagtagcttttccttttttcttttaaagagctatttaaattataaagtcttgattctgactcatgcaaccagaaatctgattaagtgctaagaaagggcactttttaaaaagtacaattgcttctgtaacaaagtgattgtctattgtaataaagtgattagcttacataattaacattgtttctcattaggtgcgagcagggaaatggtaagaacatcataagacattgaggacaagcctgagttagagaatataaattttaagctaggctaatttgaccataattaataagtttggcacaaagagaaacaattctacttctgaggtaaagatggcctttactttcactatctttttaaaataacatttatgtaatacatgcatattcatagagaacaatatactattgactttctgataagagaatattgactacttatcaacccaaatgccaaagatacagtattcttatcatatagatagtggttttttaattcatttcagatcacagaacagcagaccaattagtaatagctttatagatattgtaaattgctttagactgaattgtgttccctccatccccaatttatatgttgaagctctaacctccaatgtgatgtgatacttggaggtagggactttaagaagtaattaggattaaatgaggtcacaaaagcgggcctcaatctgaaagggttggtggccttctacgatgaagaggaatccttctctttcattgagtacatgcagatatgaggatatctgtaagtagctatactttatagctacttctttggaggttcatagtacacactaacccttaaaaggtcaaagaaattctgctaggaataaataaaatttgttttacccaatatttttcatatatgtatgtgactatgtaacatttacctctcacaagtatgtttcagttaattcacataatcactttttcagatagctgtatattaagaaatgggcatattctaaatttgataccatttataactcactttgctttctgtatgaatcactttgtacaaatgtgacgtggtttgttgtgaaaatccaactttattttgatagcctattaaaccttttcagtgagtgaccctggataaggatgactttcctggagattcaaaataacaaaatgatctagattacctttagacataaaaacaatctcaataaaaatgtctcaattaagaaattccggctgggcgcggacgctaatgtctataatccccgcactttgggaggcagaggcgggcggatcatctgaggtcaggagttcgagaccagcctggccaacatggtgaaaccctgcctctactaaaaatacaaaacttagccaggtgtggtgatgtgtgcttgtaatcccagctactcgggaggctgaggcaggagaatggcttgaacctgggaggtggaggttgcagtgagctgagattgtgccactgcattccagcctgggtgacagagcgagactgtctcaaaaaaaaaaaaaaaaagtttattttcattgtaatagtgaaatttccaaatttgtgttagtgttaactcctcttccctaccttagtgaagagctaatggaagccttcagtggaggctgggctttgatagctgctctttgaattttgcccaaactagggagaagcagagagaggaagggaagaacaaggatggttagtcgttacctgtctggataacttagggcagggctgggtagatggcgggccttgtagctagtttatgctgactctttgttttggatttctgtttttttctggttcctttgacccaggcaacacacatctctgttgtatgtgaaaacttcctgtccattccttccatggccctgggagcattttggatttgctccccagaactacctagggtactacaggagaatgattgaatcttacatgcttcatgccagccttagtagacactactaagtctgccaaaatcaaggcataaaatgttggatagtttttaatgttttactctgtatctcttgtactatatttcattacaaatttatctcatgttatatatttggccaaatatataagaaacagccaaaggaaattctgctgttcttaggaaagcctcatggaggacattcagtgagttaagagtacttcaagtttttaagaatctatgtcagcatatatggttaatcttggtattgaacccatgttttctatctaattaggagaacaatgcccacatgcagatcacataaatcctagcacactgtctagtgtgtgcacataagtcagaaaggaatatcatatcatatatttttccacaagtacttctcagagctgatatttctcagtgccttttcttaagaaggagctcaagtattttacaatactagattttcttcatttccatttggttttcacaattacctaggcacaatgtttaaagaaaatattgtgattttttttagtctattatggaataagaatattcagggatttgcaaaaaatccagttattgctttattttttcttactgtttagtagggaatacaaataaaaatttactgtttaaaaaaaaaattaaaaggaaacccagagggaagacatgaaaaagaatgtgtgcaaaattcagtgcctctataaattgacagctggaaatcagaagtgcacttggctagcttttatgatgcgtataacaaatgacaggccattcaaaggttgaagaagagagataatcttaaattaaaatagcttccaaaacaggctgacagtactgttcacagcaaattaaaaagggattgacaactggaaaaaaaaatgggggtctggaatttgagatgaggattttttaatcatttggcatttgacttcgtggataaaatcttactcgatttctccctagaggtagaaaggcatttaaaagatatttctaaaattttattaaaacgacaaagattttaaatggactataaagatttcatgtttattttgtctcaaaattcgaagatcagactttaaagataccgggttatgagatatgcaaacattcagattggatttagtcaacatttgtcattagatcaaatgaagttatatgtaaattttagtttaatgaataatgttattttaaaaaaatactacctgagttatagagtatcataaaatagtactaaaggccatgctaatattgtttcagtcttctaaaaaggtggctctgtttttgcttgcttctttcaaatgacagtcactggaacatgtgtggatgttcatgtaggcgtcatggacactggggccagttattatcttgtattcacctagattgccatgtgattgaagaagtgtgccattactacacttccaagtctgtgaagatcagttgttgtttctatatttccttagtaatcatcgtccctcatatggaaatacattggcagtgactaagccactttgagtatagagcagaagtccccagatgagtcatacaggccgttggtggaaggcttcatatttgaaagaaacaaattttatatggagatagtattatttatactcaaaatggctcctctatttaatctacaccttttataagtcagaggaattttttgacctggaggagaaaatcattaattccagaataatttaatttgtgaccgtcataaattttcagctccacctcaaagctaaaaaaaaaaaaaaaaaaaaaaaagacaaaaactggtttgattaattttctaggatatataaccaacattttctcatttgtgatagaagggtaaatggataaaattgattatcctctgtatttgtcattcattattaacagtttgtgtattctcaaattaaccaagttttaaattatataaaatcattttctcttagtattttaaatgagaataagattgacacaataattttgcatatatgctatttctggtattttaaccttacaattctcttttgaaattaccttcagtaacagttttttagtctagggaaaataattaccatattttaaaaagaataagacagtgtttttcatcggacttaattctagaggagttatagctgtttgaaaaataagataattcctgaagggtccaaaatatttgtcatcaatttcaagtataattcaaaataaggatttccaagaatatttgagaaatagaatcttccctctaatgtctagatggtataattgaaaggcagtcatctataattttaaaagaccatgcaagtgttatatataatcattttaatgaagaatactattgatatattgtagtcacatcacttcaattacaacatgtattcttaaatcgtatcgtactgttaaaattttcacataggagttcatatttactctattagttgattgtctcatacttattttttaaaggatgttgtgggttgcttttgaagattcctcaaaggcttttaaaagtggaaaagtcagggaagaagtaatatagtgtgaactggatagcctttttaaacataagtggaatggttccaaaaataaggggtaagaaataaaatttttaaactataaaaggaaaacggtgatattcagtgaacatttgaataaacagtccttaagtaaaaatagtatgacaaaattgtctttcataagaatataatatttataataatacctcaaaggactgtaatgtggattaaaagaaaacatgtatgaggtgactagatcactcttagatgatggttaaaccaaaatcagtctaattttatttatcagtatgcttcattttcataagaaaacaagtataaatcattttgtttagtctgtctaatgagaatgttgtcatctactgttaatacaagttcttgaacatggaactgtgtacatataaacatcctcttttcattcatttattcattaaattaaaaaagtcagtattaaaataacggaaaacgtgatgaattatacaattaattaaatttgctcaaatgcaaattaatttaattaattagattcttttcatggttcttttagcacaaatattacagtattctaaatagcttgtgaataaaacttttagtagctgattttgagatggtttatattttaatgaatagacaaaacctgaaaatttgaatatgaaattattcactttgatggccttcaagttatgaatatgcagcctccctctgtgtgtaataaagtatattttttgtttataatcttttaaataaagttcagttaagtttatgaaaatacaataataaaaactatcattaggccacaataaagccagttcttatggatcagtagaattaactatacatattcgggttggggagttaaatatattttactcatagagcattaaatatactgtttttagttttctcagaaaggatgtgctaagattaaaattgacttctatttttatgcattctatcaaaatctgaatatgtatatacacacacaaatgtttatttggcaagcatctaattttataactggcattaacttgtacaaataataaaaaattaacataaaatgtaaatttgagtaactggtaatcatgtgtcttgttgagtattatagtacttcggtaaaactcgacattaagaattatgtacaaaagtagccattaggactctatgtaaaaaaatgccataaccacagtgttataatattcctttctctgcctttcaagactttcaacacataatcttttctcctctcttaattaaaatagaccttttgcttcatttagaacaacatgggtaattctaaacacattccagactttctgtttttttgttagattattccttattttttaaaatggagtctggttctgtcacccaggctggagtgcagtagctcactgcaacctccacctcctggttcacgcgattctcttctctcagcctcctgagtagctgggattacaggcgcctgccaccatgcccagctaatttttgtatttttagtagagatggggtttcaccatgttggccaggctggtctcgaactcgtgccctcaagtgatccgcctgccttagcctcccaaagtgctgggattaccagcatgagcccaagcgcctggccaagttgttcctcttttgtttatccacataaataattattaaaagtcacggattttctagtatataggttatgtctgtaatgaagttaaaaataatcatttcatgaatacatcttagtgttttgtgctgtgacaaggcttagtagatacttcattgctcaaaggaatctgaatctctcctttcaacacataggattatgcaccctttctaacctgcagcagggtggtaatatgtggttgacatttttccattggttataggtggaagtgacatgtatgactttcaagctggtggatttaattgccagcacagggccctctggaactctctttctgccccatgaccttgtagatggaatctccatcagtctaagttccttcgttgaatgaaaacatactgcagactgccccactttccacacctgaattccaccagcagcaagcagtgggttgtaggatgagtgaaaaacagcaacaaaccaactactttgatgtttttacctacttaaattatatatgtgtgtgtgcgtgtgtgtgtgtgtatatatatgtatatatgcatgtgtatatatatatctcaaatacacacaacaaatatggtatttccacttaaatcttcctgaaatattattcatttacttatctttgtgtcatccttctatttataaaattactaatgaattgatttaaatctggcttcctctgcttctcaggattttttttccccaagatgtttcaaaatcaaaatttttatctaaaagttttatctctaaaataaattttaaagcttatttttttcaagtcttaaaacctttctcaatcagattttcaggagctgcacaatagaactgttacttcccttctcttattttcaatcttctatcctttttctctttagtcccgattttaaaacaatggcaggttagggaaaacaaaaacccacagcttactctcttaggaggttggaggagaaattgattttaggctcttgatagtttaagtctacatttttgttcctttccatgtccacagatcaatatattacctgaatacataaatcttatatgctgaaataatatctccaatttattatataaaattcaaaatctgtgacccacagtatgtgatgttaacctttcctactgatacagttacaccacttaatttatgacaaaaataattgaactaacatgtactatataatcataggttagaggccaaaatcaaattaagagattgaatttaacctgaattggtagattgcggtaaaaaacggaaagaagcatatttaaactatcaataaaataagacatttttgcattatgggaaactatgtatcatattctaataccattactgcaactatagcattgctatactcaccttaattgaaatatttttcattaagatcacaaaggataaaacctaaatggaaaccgaaaataaattagaggttatcaatggactaagtatgactattatgtgccttgttgattttcaatttatcaataaagtatactttaaaatatattggaaattttactttggaacttttagattttcatttgtcttattacttccatctgtcatgtaacgttttactgactttcatttgttgaatttctaggtaaataatgtagaaggcatttgtcacccatcatcacctgtgtgctcccccaagactttggccatgccaaatgtagaccttctgctatattgtaatattaatgataatattggagactttggtacaggaatgttgagaagtctgttctaaccaatacccacccacttggttccaaacttcaaattctgttggtaatatacagttggtacttgtgcagaattgttttcttctttagattttcattttatgttagtgtgtggtgactacaaatttaatctacttatataatatcttatataaataagaatcctccaggataaaagtctacaaaggaatatgacatttacacatttggcagatctgtatctatatttgtgtttggtataaatagtaagttctagatttcagcatgaaatattgccaaatattctaattccattatatttcaaagagtttatccacaaaattatggtcttactatgatttgtacatttcaaaaatttgtacaattaaacatttctaagctctacttagaaaatagcattacagcatttgccagaaaaaaaaaaaaagttaaaaagttcaggaaatcaatcttggtctaaaataaaatatacctttgtgggtaacattctcaaaattgaaatatttagaataccatttcaaatcttctactaaatctctgttttacttggcataaatacacatgtgtatacacttcatatatgtatatctttcatgcatagaaatctttccagcaagctgtgcattgattcaaattccagataaaagtttcttaagctagaaaataagtacactttgatagtctgtattttgacgttgatagcatttatttcaacttattctgaacaaattgaaagaaggaagttgtttagaaatggacataacaaataacatccaggggtttcaggaaagttttcatcttaatgaacacatctttatgctctaaaaacactaataatacctgtgaatgatttattatattttaataaaggatgtgaattctagataaaaaatttgatttttgatttaaaataaaaaactttatatgaaataataagacatttcaagaagtagaaaagatcacagggcatacccttggaatcaagaaaataaatttgcattaaggaaaagcccctttgagactaacacaaacagtaaattcaatctcattgcatttggaatctctaaaagcctgaaaaactcacttttttctgtcctcacacacacacaaaaaattatataaggtttttgcagtgtgtagatgtatcagaactaaatttttttttcctttgaaatctatttttcttattttttttaagttccagggtacatgtgcaggatgtgcaggtttgttacataggtaaacatgcaacccatcaccttggtattaagcccaccatgcattacctattattcctaatgctctcccttctcctaccccctgacaggcctcagtgtgtgttgttcccctccctgtgtccatgtagaactactttttaaatgatgtaaatgtcattaattgtacatgtattaagtacacatcagtttacatagagaacagaataatatgatctgattcctacagtgattcacacacactcctaccttcctgtttaagaaggtattgcggccgggcgcggtggctcacgcctgtaatcccagcactttgggaggccgaggcgggcggatcacgaggtcaggagatcgagaccatcccggctaacacggtgaaaccctgtctctactaaaaatacaaaaaattagccgggcgtagtggcgggcgcctgtagtcccagctacttgggaggctgaggcaggagaatggcgtgaacccgggaggcggagcttgcagtgagccgagatcccgccgctgcactccagcctgggcgacagagcgagactccgtctcaaaaaaaaaaaaaaaaaaaaaaaaaaaaaaaaaaaaaaaaaaaaagaaggtattgctacctgttttagagtatgtaattttaaaaatagaaaaagaaagaatatattaaacagtaataaaatgtactggcttttaattttaactacaaattgttagaagtgtcacatctaggaatagtgaatggaagggaaaaattgaagactgatgtctcagtaaaatgaatataaaagattttcaactggatcagacaaatgaaaaggttttgctacagatatatttggaaagggcagtgaaactgacaaataatgtgaaagatcttggcttccgtcagtttgatacagaatgcaaactgacaagaaagtaaaggattcttttaaaaccatgagtaagattaatatgaaggcaaatgcgttttgggaagaatggtaaaattcatttcagtataacatcaatgtttacatcagagtaactactggtttaaaattaaattgagtttattcttaacatgtctaattttgtgttttgagaaatatgcattttggtattacatcttactgaaaagtcatttatagttttattgttgaggattaaaaatctgataagtttctaagtaattaaatcttgtcagacctgccttctgatgatgatgtttggcatgcatgcattgagttctgatgcagttttaaatcatttcagaaagccagaggtgcaagtgaattgcagaagagtcacgcattgatggtgaggagactatgtcagcaatttgaagtatctttataatacatatatgactcctgtggtagaactttatggccttataagaccatgtaatcatcaagcctcagtctcttgaggcttgctgtaagtgtaaaggcacagtagattacctcatcattctaatggaggcagcagggaaattgcttattctccaagtgcacagcaagcattagtcaaagtgctgtacatgtaagatatgcaggcgttctatccctgggtacatgatttacatcaataatgattttgaaaaaggcaaataaaacaatgcattagaaaataatgggtttgtattggtttcaacatccttcatattatctcttcttgatagagtgagttttatatagatacatggaatttataatcagtacatttattttaatgcaaaaggcacattttgccattttagttaaatgaaaacaatgttaaagtgtaccagtcactgatcactttttaatgggaaattatgtttttgtttgtgagagttgggtctacattgcttcctcttagcaacttctatctgattcctatttcttgctttatttttttattttttttattttttagacgaagtcttgctctgtcacccaggctggagagcagttgtgcaatctcggctcattgcaacctcggctcactgcaaccactgcctcgtgggttcaagtcattctcctgcctcagcctcccaagtagctgggactatagatgcatgccaccatgcccgagtaatttttgtatttttagtagagacagggtttcaccatgttggccaggctggtcttgaactcctgacctcaagtgatctgcctgcctcggcctcccaaagtgttgggattacaggcgtgagctactggacctgtccttgcttgcctcttaaacctgaggattcatagacattattggtgtcattttagtgataattttagtcaagcaatattttgaattgtcactgaaacatgattcccaaatctgattcttccttatacacttcatggctaagatgcagattgactactctgattgccttttttaaacaacgcggtttaatggatatctcagaagcacctcacgttatgttcaaaattgaatgtatcactgttgtccccaagtgtacctctcttccaatgttcatatctttgttaataacactaagaacccaagtcagaaaaccatgcttcctgttttctcctttcccacatttgttactgtggcctgtagattttttctcaacatctttttaatctctttccactctctatatccaccaccgctgttttagttcagaatggtattactcctcaccagtctgatggtacctgctttctctcttctctattcacatctggctggcttttgcagatatgattatttcatacttcagcttattatggccctctgtaattctcagaataattattttaactttagtattcctagattattataatcatgtctctctaataacatccctgcaattgccccacattcctcatccattcagctgttttgaacaatgttcaactcccagaatgccctatgtctatttctgcctgtgtgcctgtacagcgagttcactggatcaggcatgcggtccttctactacctctctgccctttctttaatactgcttatcacctctttcagaaaatcttttgtgaccactacttctaccctgcccctcaaaacctttgcttagtttctgataggcaggtgttactcatagggtctgttatgcaaagcaaaatttgatttagatgctttatctatgtgtcttctcaattagactcaaagtatcttcaaaaatagtgatcacaacttatttgaaattgaattttaagagccttatgaagaattattaaatagtgatttttaaaaatgattaaatatgatgctggagttagacctttttctttctaggatatatcaattacagtaaaaaattgaaactgtaatctgtcacaatactcttttgtgccatctgtatctgtttggatgttttgttattgcaggatattttgatattgagagtttgtccttgcaatatcatactagatcataccatcatgttgatatctaggtatttcctatttgtcaatatcattgtgtctactggtttattgaaatgctttatattaatatttccatggctagttgtctttaaaatcccagtttaaaatacagttcttcagagaggatattcctgagaacttgatttacggtagccacctagtcaatctctatggcatctccagatttaattctttaaagagcactcatgatgttcttacttatgtgtttattgtgtttctcttccagtaaagtgttagaagtcctgtctgtcttgataggccctggagctcgggtataggagtctgcaaagtatggcccactgtctgtttttataaatacagttttatgggaacacagccacacccatttgtttatgtgttgtctaaggaagtttttgtgctactgctgtaaagggagttgtgacagagaccatgtggaccatagacctaaaacatttaccgcctggttctttaagaaaaagtgtgcctattctcgtgctcaagagcttagaaaggttccagacacataataggtgtttagtaaatatttattggatgaatgtctgacagaaatgagatgattagaaaatgaagcacatacattgggaaatacttaacaagaagcttcatagtgatattcactgacttaaaggacttatctaaaaattgggccagtatttacaccacgctcttcagaacatctccattaaaaggggtgattttatcacagaacttgaagttaaactaaaaacaggattaaatggacatttgaatggatgaaatctctctgattcagatgatacccatccaccgcctatcattgttggttgaaggaaagaaaaggaaatgttctaccatttgtacttggtcagatatgatgaaaattatttccaacttaaaaatatccaacagagaggtacagttcatatattcacacactctttcattcattaacaaatagatattgttagtatgtaccaaaacatactagttattactgtttatggcgtgcctgttatacgttaagtatagcatattttaattttcacaaccctagctattgtacataatgttttctccacctcattcctgaaaactagaagtctgtgcaattgtatagtttactcaaggtggtacaactgtgcattaaacacaggtttgtcacatcccattgcctctttcactatattctaggcatcagggaaaataacgtggtgcctaccctacccagtataatagaaggcacacacataaagatagtgaaacgtaggaagtattttaatagaagaatatagaaaaaaataaggagtggggagggagttgatactctgctgggtgaggggagatggtgtggggaaaatcgaggaacaccctgtagagcaggtgatgctgaactgtaataaaaaagaagggagaagtttaacaagtaggcataggaaaaaactcagtccagacagagaagacagcatacagaatgacatttgaggcaggagtaaactttgcatcctctgagaatggcaaaagtcttgttatggcttgggcttgttgtgtttgaaagagcagtaggagaggacaccagaaggatggatggaagccagtcataaaagaccagcttttatggagaaccaacaaatacttttaattagggaagacatttgccaagtagaatattgtggcagcagtaggaggaatggatggaagtgagctggaattagagggagggagggtatttaaaggttacacaaaagacccaagagtacggctaggagcagaaacgaggatagctacactggcattagaaccgacatgacttggttgtttaccatcctctattatcttttgtcagattggaaaacttttaagtcatttagaaaagtcttatgggtacatgttttgatcatgtcagaataatttgagctttttaaatctatttgaaaaatctaaggttttgtgggatattgagttgtgaatgaaaattaaaaatacatgatttattggaagagaaaaagattcctgtctgtattaagatctgctgagtaatacacgagcaaggacttgtaaatttaatgtgtcaactctaatgagtacattaaaatctaaacaagtcatgctcactatgttgtaggcatcctgaatactaacaatattgatttttttgtatacagatgtccatctctctgtgtacgtaaaacatgtaatgttctgcatgtatgtatgcatacatgtatatgtggacaatctctatacatgtgcaactagagatacaaggatattaacctcatgttgtcttagaaatagtgcttgagttcattcatacctttatatattatgattcggtattaatctgtagttcaatttctgagatgtatatagtttttttttttcttttcattctgaagcagtacatgtttaaaccaacgggtcactgttcttgattatagccgacttctatgtactgtgcttcaatggatctgatctttccatcttaaaatcaccaggcaactctttgctctaaaactggttgacacaaacccttgagtaccaagctgtgtgtgcctcattgacaatatcacccttgtccccaggagccttgttatccttcttcaaccatatctcattagtcacttctaatacttttgatccttctttgtgaattcagcagtccagatttatatggagacactaaatttcttatgcagttgggcagtctcacagcaaagccaagagatttcccttatctaatttggtctgtatttctcagccagagtttcttctcagcattaacaggagcttgtatgtgcataattttgtgtgtgtgtgcctgtgtatgtgtgggtggtgtctgttatgcctattagacctgatataatttcatttcttttactagaatcttagtgcgactattctgtattcaatgcagcattcatcagtgtggtttgctttctggaacacttggaatatgccattgtaaaaattattttctcaccaagttacataagatattaaaaatcttttttcagtttgccattgtcttatagcaattgaaatggaaaggttaatagactattaacctttcttcatgagattcatagcaagaaaattaagtagtgttgttggacattactggggttggggtaagaagggcaaaagttccttgaggaaaaagaaaatactaggttttagtcactcatacttggattttaggagtcagatcagaatttatcaagataaattaaaaatatattttaaatgctgagtattaggagacagagaaaataatgatgattaatgatgagagcaggtaacacttattgtgcagttactaaatgacaagtagtattctaagtatgtataatcttcaaaactagccctgtgatgcagatgctattattatccccactgtacgagtgaggaaactgaggtttagagagggtaaaacactttcccaagatcaagtggttacttctgacagaaagacgtgcagtctgtgagagggtggataatgggtgagaatagtttttgcacacattacatacattcacatgctcattttaaaaataccacttagaaaaaggcctcaccagaaagaaaatctatagtatgcatgaaaacaaaacaaaaaaaaaccacacactttaatttggagtcctttaaatttggtcttaattgcatattcattcttctatggcttccggcttcatttctctgctctcagagtttctgatgtttttttaaacgcacacattttatttctctttttaaggtctaaatgaaagatctttagggtatttcttgttgttttcatttaccgagagtttagcaggctatgtatttactgaaatattactctaaaatatagaatagaaatttaacaatttatttactcatttaattacaaatactaaaatttctcataaaaatggctgtgaagtggccgggcatggtggctcacacctgtaatcccagcactttgggaggccgaggtgggtggatcatgaggtgaggagatggagaccatcccagctaacatggtgaaaaccctgtctctactaaaaatacaaaaaaaaaaaaaaaaaaaaaaaaagttagctgggcgtggtggtgggtgcccgtagtcccaattactcgggaggctgaggcaggagaatggcatgaacccgggaggcggagcttggcagtgagcctagattgtgccaccgcactccagcctgggcgacagaatgagactctgtctcaagaaaaaaaaaatgactgtgaagtactatcaatagaagatattgtattttcttcagataattatgctaaagtttctactttattttacaaattacataatgttcctaaatttgaaatgaaaattttcaactagctgattctaatgaagaatatcttatgatgtgagtgtttaaataaattaggagattaagcagaaggaatattgctttacacaacataaacagatttacattctaattgctctatgtaaaagaaatgtgtttttgttcaaggaagaggaaattactgactggactaaaacagtatgctgacaggtcaaaagttgttgtctatgtaagacacttagggagatgtgcaccgtacagtattttaatctagctgaggaaagaactggaataaaaatatgcttgctaattcagttctcattcataaatttatttgaccttcacaccaaccctataggctgtctaggatccttagtatagctatattcatttttttagacgaatagaacagaagcacaagaagttaaatgatttgttttaagtagtatgttgtgccagtgattgtgattctaggctatcaaagtcattaataatttatttggttttgatactactaaggagagaaaagcttagaatgcttaaaggataaaacaataatttgaccttggggctcctatatttctgaggtttcttatacaaaatacagcccttctccctcctcaaatcttacaattatcattttatttcaagtgacattaaatcattcaattagtagacatgatattagatactagtgtcttctattccccttgcattacccttgttttctttaataataaagtggatttcttctgagctcctcctctgtgctccacagcgtgcagatttcattaaagcagaacagctgtgttctgggcattggccaggtgctcaatccgcaggaaactaaagtgatagggggcaaggccagaaatctcagtaatacaggggctagacaactgacaaggacaagggccttttcatatttgtaccaaattaactgtaggaataaggcttatctcctcatcaaggtccttgtgtgccttggagccttctgctctcccatcctcagtgcgaggtggattctggtgcccgagacatgattagagagattagatttggtcttcccatctccctgtaccttattcatctttcatttacactgggattagatgagattccattagccaaatccactgaaaagattcattcattttaatatttatgcacactgtctactccttaaagtggattctttttttccctgtgcacttaattagatcagtaggtttcttcttattaacatctttcttttcagagattagggttggtgaataaaattagtgacatctggctcagcttatctgataatgcagctcttttcttaaggtagtcaacatataaatgacttttcttaaggtagtcaacatataaatgactaccttatttatatgttgtgaaatgaacgtttgccacaaaagatatcttttgtttagaatcatacttacaataagtgttgaatctaaaactaaacaaagtttctaatattctatgattgtccaaaaattaaaggtgtggaggaggtaacatttaagggcattaaaaactagatttgaaacccttgcttgcttgtttaaggaatagtaagtttccaaaactaaaatgaaaatttgcccaacccaaagagtgccaaaatgtagaatgaaatatagacaaaatttactgtcacaaagacagtattaaatatactgtcttaaatataaaatagtacttaaatataaaatagtactaaactattagtaacaatagtttaaataacatgctaatttttatctcaatgcaaggctgtaatagaatagtattataaattacatgaaatggtaaacatttttgcttgttctcttatttaactgtatgatatttggtattgttaaacaaaaataatttttagtatctagtcccttacatatctttaatagctacatctcttaaagacttattagagttattttatattttcagtaagtcctaacaaatgtttttctctttttttcttgcataaatctgctttattagaaagctataggtaagggtacaaagattcagttttaaaagatgagtaacttctggagatctaatatacagcatggcgaggatagttaacaatattgtattgtaattttctaggagggatagatcttaaattaattcccccaacttccaccctaatggtagttatgtaaaggtgatggataagttaattaacttgattttgatgattactttacaacatacaggtgtatcaaaacatcacatttcatactttatactattttatatgtcaatgacatctcaaagctgttacaaaagctgtagttgacattataaataacagtaagattcttcaaatagtcatatggtgccatcaatgtatggtgaggccttggaccctgaataaatcaagaaaatgtattcaaacttaatacaaacttaattcaaacttaagagggagcaatagtgcaacattttattggttgaagtttgcagaagaacactggattcagagctcgtcaaatattctgtattccttgtcataaacaagatatagatagaagagtcgtgtcttttagaagaattagcagcaaatataaggggtttcttttgtgctgttacaaattagatttttctttcttctcttgagaatccagactgaacaatagaatactctaaaagggagaattgctgacaccaaggccagttttttaaaactaagtaaacaaagaatagagatgtatgcttggctttctgaatcgattatcagtgaaatcctattatgccgttcagaataaaggcctcaaagtcaaggtttgatttccaagcattcactgcttttagtaggcttggccttggacatctataaaagacttaatttttacaaaatcgaattttctaacagggataaagatcttcatttcttaaaagttgacagaaaatgagaactaattttactcctaatctaagacaattagctaaatttgtcagcaactggtagtaggttcaaggctagattgtcactgagcagtcttctatagtgaaaaaatattgaacactcatgtacttctaatctcatctgaagcaagaaactggaagtatatgtgaatgtaaaacattactatttgtcaggggtagggaggaaaaagagggcaactgtcaatatataataaataatatcatatagaacaaaggtccccagcccctgggccatggaccggtctgggtccctgacctgttaggaaccgggccacgcagcaggagagcattacttcctgagctctgccttctgtcaggtgagcagcagcattagattctcataggagcatgaaccctgttgtgaacggcacatgtgcgtgatctaggttccatgctccttatgagatatctagtaatgcctgatgatctgaggtggaacagagtcatcctgaaaccatgtcccacctccatttgtggaaaaattgtctttaacaaaaccagtccctgtgccaaaaagatcatagaatatataattgagaatataaaatacaatataattttaaataataccaatttatagaataccattcacctgttatacatattattaaatatatcttgccaaatcaaaggatttttacggtcaaaaatattttaagttttttcgtaaagaaaatttattctggaatttttatattaaacattatttggctactaatttacattgatatttccacaattaaataaaatctttgacattcaaataaagattatgacataaaataataattgcattttaaagtctttgtgatatacaatgacaaatgaaactttttgttgaattttgttgatatttattgaacttcagtaaatcagagttccacaattattttttgagattaggttttatatgaatgaaaaatacagtttcataatctagagtaatatttgctgaaaataattttccaaggaatttggccttgttttatttttcctgttatgaaaaaatgacgttttgtaccttttattttttaagaactacagtgtcaggaaaacaggagagactaaaaatactgtctaagaatagagaaaggcaccagcataaccacataaactctttataatataaaacaaaagatctcctgaaaaacaacttttaactttaaaaagcacttgacttacccggttgtaaccagaatagttaaaaacaaaaaaacaaaacaaaacaaaaaaaacttcctaaataaactctacccacatatttagagagacagacagaaacagagataggggctaaggggcatcctggggagagatagagacaagggaagagagagagagataatgtgtgtataaatacaatggaaatggcagagcacaattcgtatccaggaaatgacataaacttgttttagcatggccggtattgtgcatttagtgttatattatctatcatctacagattacccttttatttcagcattatttatcctgagtgtgctaatagcataaaaatggagaaatgttgggcactttagtaatcttggatgagctatttaattttataaggttaagaagaaaaaaagtctggtcttttcaaggtaccagagtaatataggtttattagtcaaatataatgcataatgtggatcagaaaaatataggcagataacccaaggtctaaaatagtattcattcttccttgttggctttgatgctttatatattttcttttccattttttttttttttttagctgctttcaatattatttgagaaaaaactttcctagtgaagcagttttatcctactttctagttttggtattttaaggaattgaatgaatgattcttgctctataatactctgaggaagaactggagacacatattctctccgtagtataaatctcttgaagaacattgttcagtgaacacgatgtgcatgttgttaggtagatccagtcaaactgctctctacaaaggctgtagtaattttgcattcctatggcagatcgtctttgaattttgatttctagacatccataaaaagactgtgactaataggataatggttgcatttaaaagtccctgcaactatatactaacacatggaagtgtctgtattcttacatcttactacacattgggtatatcaaatttataaaccgtactgatgtgataggtgtgcaatgccaatactttcattctgagtcaaatttaaaatcagttctagtgcctagtctgggaattctttatatgatttgctcatttgtagatgaacacattttgagagaaatattttgaaatctaccttagtaatggcttgtctgaaaaagaaaattttcaaagcatcaactggaaatcttaaaacatattgccaggataataggaatattgtagagcttgactttttccctcagtttataaaagtataattcacaatcagtgtgtcagtacccaatacttagtagctgttgagttatcaaacaaaactaagaaaaagttagcagccttaaaaacaaataaaactttattaaaaataactagatgttattgcctaatatgaatgaaagaatcaaggaaattaaagagatagaatagattggggattaatgaagtctatctggatcataaataaacatttgtttagtagaatgttactataaaagtcataaatgtttaagagaaaacacaatgttcctctttctatgctattttgtatattgatataaatattcatgaatagtgggtatcagttcaggttatctgtgtgaatataaattctcatataactggctgcttagtgttcattggatcatgcttttgaatatgaattctctagtatctcagatgcacgatggatctgatgcagctcatgaatattcacacacacacaactgatctttttgaaagtaatcgcatccataaagatgaaaatcttgttagttttcaataatgaggactgctttagcatgctggtcccagaagagtttcacaatcaccttgtttttgttgatttcttttttggtaaatgatacaactttaaaatataaacacataggccgtgcatcttgtttcacaggcgctgtttttaattttacctttaaaaaggcttgtgcatgatttaaccatgatggcattcatttcttttatttgctgtcatcacagaaaaaaatagaaagacgttaagctgtatctccagtctttatcctaagcacatttccactgttcaggcttggtcagagattgtcaaatgcaaagtggccctgtctgctaatctctggggacatggtgtatattttacatagaaaattatgcctttttttgtgtaaagggaaaattatattaggccaattaaatttttagtatgctagacttgagaagttatgatcatgaagggtcagttataaattatgcactattttaacccatattatatcttacacttaacccatattatatcctacattataattgcttctctttcattgtaatgagtggtatatgtttgtaatacctatccaagattagtttctagttataaatacgtatcaaaatcaatcacctggcccttatcggcaccatgctctaattattaatagaaataaccaggagaaaaaaaaaaactattgtttatgaaggtagtgataaagtgtcaactagtttgtttctaacacggatattgtcaagcctctgagtaaattttcccattactaaaatatgtacatttttgttgtataaacatagttaattagctatgcccaatgactttttttcttttttttttttttaaggtagcaggctaatttatgttgctctgccgcagagagtcatcaatagttgattactgtggtcttaaaactctgtcctaaggtgccccataggtttcctcagaactacctctgaggataaaaaggaataccactcatttctcctcatattctatgtgtcacagtagttctcaagcaggagtgattttgcccgcaggggccatctgacagtctggagacattttcgcatgtcacaacttgggggtggggaggtactagtatctagtggatagaggccagagatgctgctaaacattttcacaggattagacctcacaacaaagaataaccgaggccaaaatgtcagtagggacactgtcatacaaagttttgttttcagaaattctctccagagtataaacctcttgaaaaacatctttcgatgaatactatgtacatgttggtagtagatccagtcaaactgtcctctaaagtgtcgaaaacttgttgataactactggattagagttattttataggtagaacaatgaacatatttaatattattttgtaaataaatgaagacattcagtttttaattacaaatttgaattaattaatggtttctctcttttttgttagcaacaattgtgttaaatgaactcaactggacaagtgccttagatgaagttttcaaaaagaatcgcgaggaagacccttcattattgtggcaggtttttggcagtgccactggcctagctcgatattatccaggtaggtgcttagtgattcaatcattgtcaagttccagcctcaatgtttctggagaatactctgttatcttccctgatactgtaagaaaaatatgactatatcacactacttttataaggaaagaacattcctctttacatggctttggattgaccacagtcactttaaactgaaatacctaaggagcagttgtggagctattggtacctggaatcaggccatgctgctgtgagaccatgagcaggtatccttaggtatatacctggaacaggaaattaccatcaatcttaaaacagctctgagataaaggcccaactgctcagcatgcaccaagctgtgagtcacattagagaattgaattgaatttttataaattgattgaaatttgtaacaaaagtttaatgtgtttaatcagtagacgtggatctgttaaaatgagtaggacaagaaataaaatgaaatcacaaagaaaatagagtttttcttatgtgtcaggttatatcacttctgagtgcatctcagtgatcatacatactcaatgaagatgaatatattttatgttaaagtgaaaacatctttttataaatatgtattataaaaagagtaaggagaaatagtaatttctataacaaaatgaaaaattaattcctaggacatcctgaaaacctattgaaaacactttaagtgaaatgtctactggtgttttttactttctccactttttagagcaagctgaaaaacataaaatgcgttttctttctcaaacatgatctgagttatgggatacgtgctaggtaatttggctttaaattgctacagtatgaccttaaacagcataattcttcttgagacttgggtgtcctaaacatgtttaacaaattgagttattcatataaaaagtcacagcagtaaataagggtgaaataaaaattagaaaatatataagtttggattgtaatattatagcaatgaatgaaagtatctgggtatcaatggactgaatggtactcaaattaggtaaaaaccatataacttctgcagggttgcagatgccagatggtaaaatcagtaataatttttttccgcataagtccaacacactaggaaaagccaagtttgatttaaatattgaaaaaatgagttataattaaatatttgtattattatctgatgggaatatattacatagtttatcattataatagtggaattttccctttatggaatattgttcactttagtagaacctttctaaacataatcttgttagtttattaacatgttaaatactattatcagaagacttaaaatttgagtattatattatataatacttatataagacaacataaaggaaaaagacaacactgctcatgcgcataataaacctgatgtaataaaccttaaaattgtatcaggtcttataaaacaattataaattagaagacctgatataatttaaaatataggaaatagatatctgatgtcctatcctataatatacaaatataagaatatatttgtcagtaacttacagcattatgtagctttcaagtcttttcatatatcctttatcataacaatattccatatataagtaagggaaagagggaaatgataattaaaagaaaattaggatgataatgagcagtcaagagcccagtatcggagagaaaatgatgatatagaggaagagagaaaagggttacaagagaaaaacaagaagaggagaggaaggaaagaatgcatgcaaaatgggagagaaaacatggggatcaagagatggatggaaagataagttgtattatgaacccttttcaaaaatggctcttttaacaaatagcagttaactttaaaaattactaataaaacatattctgtaattctttaacttcaaatgctaattgagggatgatggctttaattttttgatgctaatcatatattttcaaatgtgttgacatttgttcacttcattttggaaaacatatttagatatttagcagaattcatgtggtcttgatagaggcaggagacagacaaaaatctatgaagatgggacgggtttccagtgaaacattactttcaagcagaagacggtttaaagcctagctataagtcctgggtaaatcctcagaccagattgagaacctcccttcttgtttgatgtgctttcctctgattgatccccacccttcatctattttacatatacgtaccctttcctaattggttttttacactgtcatgcccacctttgagaagtgcctttgttttagcctttttgcatacttacaaaccaatcaacatgaactccccgttctgagtccataaaagccccagactcaaccacactgagtaagagaccacctgacatcaggtagagggatgacccatacattccttctgctctaagagctttctcattgctcaataagattcttctctgctctccccacccttcagttgtctgcgtaacctcattcttcttggaagtgtgacaagaacccatgaaatgtgggtacaaagaaagttgtaacactatggtcctctgccctccgctggtggaggacagctgccccatacatcaggaagcagtggcagggctgagccagccccagagccgtgggccagagtggagcaagggactgacagagttgttaacctgccaccatccattaggctgcagatggcgggacttaaagaactaattagcatgctgtaacacatgcttcagggtcaggggcacccctgcctgggtgccaccacgtttccgcatttgaggtgccagagtccaccatgagagtcacttatgacatgcctggtctaaccacaagccccacatagagcccgcttctgtgccagcacttggaatggcggaccggagcctgcactcacttgctcacacaccccctcccaccagaggctgggtgcacagtcacagtggctgtgggaaccacgctggagtgcaggccgggtgctgaccagcaggcacagtagatggggtgtctcctgcggtgaacccggacccaagcaaggcctgggcaggggtgtcactggccagaggtctctggctggcaaagtgaccaagaaaagtcctgcactagtctttccaaaacattagctgtggaagcaaccatgtgcccactcacaatacctaggttttaagtaagagtttggcaagcaaaatgactcaccaaataacaggctgaattcatttacctgttacaggaaggtcattaaaatagcccacttgactgctagggaatacacttgaatggattttagtttagtgaatctgttactgagttgctctttatgacagtaatgatataatataaccaagtatttagtaaagacattgagacaatgtcataactttaaaagtgggcgattgtgtttctgtttttgtaagactgtgtttttaacacaaaaacacagctttgttgaaatgacatgattaaaaaatttttggggagactatatatacttctctgatcatatcattttgatagaagcaaaataatatagaaggactcacccctgtttactgtatgttaaaccagaggtcaaaaatagtcttttagtattttaattatcttaacaataaatggcaacagcacatatgttacttctacttaattgaacttttacatggaagacttgaccctcaggctaggctctccctgctagctgtgagaacctaggtaggtctcctaaactctctgagacctaatcattaaatttgaaaaagtggaacattaataactcctcattttatcccctgggggttattgtgatcaatgagataatatgatgaaaagtactttgaaaataggaaacagtaggcatttctacaatagtgcatgtcaactagaataattttgcctaaatgcagctttctctttatctcagacattaaagaacataattgaagcttacagtgagttgacaaggaaactgaaatagaactctggaaggaatctaaacatgactgagccataaagtcaggcaataacaccacgtagtgaaactggtcaggagacggattgtagctgatggccttaggtcacttttctgtagggctgccagatacgataaaagatgtccaattaaatgtcaatttcaaataagcaatgaataacttgttagtgtaagtatgcttcatgcaatatttgtgatacacttttgctaagaaggtatttattttttattgaaattcaaagttaactgattgtcttgtatttctttttgctaaattcatcaaccttgtctttcaggctttcagtttctatatttgtaatatgggaaagtcagcttccccattacttcacagtattgtaaagatcaagcaaagcctattcgtccagatatatagaattttataattttcatttttaacttctgtaagctacctatttttatttttgtaagtgaatacttgccacagagctattgaaaataaaatattttgcaggaactagaaccttctgattcacaatagaagctaaaaaatatccttgttgattattaatatgctacttaaagcagagtcacatacaaagaggcaggtgagcaatttatttttatatatatacacacctatatacatatataggtatataggtgtgtatatatatataggtgtacatatatgtatatatatacacacatctatacatatgtacgcatatatatacgtatatatatacacacatatatatttttaaccccatcagtattatgtacccataataattaaaaataaaaaaattaaaaattgaaagataatatgtataagttttgacatacacacacatattgtagaatggttaaatctagctaattaacaaagcctcacctaacatagttattattatggtctatatatcatcattaactaaagtcaccgtttatatgatagatttcttgaatttattcctcctctctaactgtaattatgcgtcctttgaccaacatctccccatctcttcctcccttgtaaccaacccagtctttggtaaccgccattatagactctgtgttctatgacgtcaacttttttttttttttttttgagacagagtctcactttgttacctaggctggagtgcagtggcgtaatctcggctcactgcaacctctgccccctgggttcgagcgattctcctgcctcagcctcccaagtagcagggattacagatgcatgccaccatgcctggctaatttttgtattattagtagagacgggttttctccatgttggcaaggctggtctcgaagtcctgacctcaggtgatccacctgcctcagcctcccaaagtgctgggattacaggtgtgagctaccacacccagctaagatagacttttttagattccacagtaattatattcttgaatcagatagccagaatataaaccccacctccaccagtatactttgtatgatgatgacctttggaaagtcctcattgacctcagctgtgaaacaaggaggataacaatgcttagatggtataattgttaagagaataagaagcattaaatctgtttggagcatattgcccagatgtaggggaaagttagagtactctcatgattttcatttatcagattatttaaaatacatagaaacactgacttccagtgagatctctagagctagcgtaatataaaggtacctatgcagtgctgactcaaaacagtagttccgtaattaatggagatttaaactcttaatgtctgtccttggactgaacatgaacctgctttataatttcattgatgtatatggaaataagctaagaaaatcattggtgtctgtcctttttcttctcacttcttcttttttctttttttcctctttctccaccctctttcttcttcctctttctcctctccttcttggaaggcaggtagactatgaggagttctaggttcttataaaagctgtcatcaccgtcactttgtacttttaagtcatattatatttctgtacctgtttcttcatcagtaacttgggatgattgaacaaaatgatttctaaagcaagcactagttttatctgcttatagcctgctgtagcatttgctacatccacagtctttgttttgcaagataagtagaatgactagccctagtcatacagctagctcatgacatagatatgattaggaactcatatttaatgatgtcttccttgaatatgtgctcattggaaaatcagtttatcttgcaagttctttcctttagaagctcttaacttatttatataaattaaagctattaaaaactgctttcaatagctatcaactttgtgaattcttatgcatcataaaaaccataggtacaaactggtcatttcacctgttaatatctcctgaaattgtaccaattgttgcagtaattgggattgttattaggaatcagtggttcattgaaatgccaatgtagccagcacttactcttttttttagacaattagttgtatttattaaaaaagggagaaaactaaaaatctacttcatctccgtatgacgtttacttaatgtcttattatttgttctttctctgccctgcctcgtttgttaatttcaaaactatgagattacaataaaggaacctaatgtgtattaagttaatgtaaagtagacctctgagagacatcttcttgttgctatttctgctaggattttgctggaataaaatgcaaaagaatctcttacaaagtatatggaatgactttttttttccatacaggtagccaatagctcttaaattgtgtaccactttttgaacaataatttaggaatattttaagcatcaaatagcagatgataaggtagtccaaagaatactttttaaagtttagtcataaatgaagcgttcgatctatttttagccaactagaagaaaatgggataccagtggagcctcaacatttatagtatttatagaagtactgcttttggttttctctaaaaatgcctgattttttttttttttttactttaacatttgtttatggacacatagttcaactataaatgtatatagttgttgatcattatataaactttaaattgaagtgtttattacattttatgctaataattattaaagtccagtgtattagttaggactcttactagctaccagttgaagcaaatccaaaataatagtgatttttaacactatggaagtttggtttttactcatgtcaatcagagttaacgtagactggggcaggtagggaaactacacaaataaggggtctgcacccagatctcactactctgtcattctctgagcatgggctctgccttagagtctattgttgttacttgtgctctttattaggagcaaagaatggtattcttctttgccccctttttaagggaacttcccggaaatcacataaagcattttctttcatttgtttctggccagaatttagtggtctcttggtcatagttaccttcaaaatggccatatatccagctaaatggcagggggctgtactaagtaagaaaaggaaaacagatattggggaacaaaaagcatctctgctatggttactatatggacatttgtgttttaaaataacaagttgtttctgccttttagaaaatttaaatttaattaggtagtcaacttatacatctaaattaaatacatcttaaatttagattgcaatacaaattattaaatgactaaatgccaagtcacttaaatagaatagcaatagatttgctatagaaattttgaaaaagaagaggtaattatggattagagtcatataagaggtttatgaactttggattgaaaaccaagtcaatgaagaagagaaggcaaaatgtttctggagggaagaatggcataaaataaaaatataaggagatgaataaccactgctggagactagtgaggtcagttaatccaatagtttgttatagaaaaagtaatattgaatcaaaaggtttattaatggtagaatatgtcgccttgaatgtcagaatggtttgggatttaatgtgtaggcaaagtaccacaaacattttgggcactgtaatgcaatgattaaagcacttaatattatgattagaaggagaaagacttggggaagcttgaccagaagatatgctattttaatggtcagatgtggaattttaaagatctgaaaaagggatcaaataggaattaattcttaaatagaaatgatgatatcagactttattttttaaaaacatgaatttaatgactgatgtagagtgtcagttgagtatcattttttaagttgaatggatgagaatatcaaagctgtttaccaaaattaaaaatcaaaagttcttattttgggagaaaagtgatgagtttaacttagaacagtaaagtttgaggtgttgacaagagggtacaaatagctctgtttacgctcaagcactggtttcatattacgtggttttctttgctgtatactatccatcaattgtgttgtgtggggatgcattttacacatacacaaaaggatgacatactgttttaaaattctgatttcatcatgattatgaaggcaattctgtagcatttttgttgcattttgtataaccttatctcttacctgaatctgtcttatttttcacagataatggtcgtaataattgttcaccttatggtcaaccaaggatgcagtcatacctaaactgactaaatgattgattttattgctcacaggttagagtaggtaaacaggttggtaatatgaaaatgagagccatttgtaatttgaatggggataacattatatgcaaaatatgtaaataagtattgctaaaaaaatttagctgttttcaacttctaagatatatctctcaatctgtttcttttttctttctgtgttaccaaatttctgtacttatgccattcatttttagatgcatagaacatctttgctgtgtaattcatttatgttcagtatacttgattatgaaaaattaaaaagatttttttgtcaaaaactcagatgtttcaagcactttctcagatatgctaaatataaacttttaaagaaatctatcactatcaccatcatctaagattttcacttacagaactaggaaacttgttcctgtagaatcatagtttgttttatgtttttagcaatgtcattattgtcatctaattgaatttatttgcttacaaaaataagaaacatgtttctctgtcagacttcacgtttttgtctgtgtagcacatatctaacatcatttcccagtaaatcctccccaacacttgcctcatagaacttactgtgctcacgcttatttccaagtcacttaatgactgcattatgggacatctaaaggattaaatgtttgtgtaccatttactttattgagtatttcatttaactacccgacttttccctgttgactgctactcctgctgacagacagatacccctttaaataaaaatgctttaagtgtgttatctggcatcttcagtattaccagtaatccactttgtaataagggtttttttttttttaattatggtgatttatcctcagctgtaataccatgtatctgtgtatgggtttctgcctattgtttataagaagtttgagaaaacttctggaaatagagaaaaccaaacaccacatgttctcactcataagtgggagttgaacaatgaggacacatggacacagggaggggaacatcacacactggggtctgtcaggggatggaggactaggggagggatagcatgaggaaaaatacctaatgtagatgacgggttgatgggtgtagcagaccaacgtggcacatgtgtacctatgtaacaaacctgcacattgtgcacaagtaccccagaacttaattaaaaaaaaattctggaaatattacagtggaaatatcaaagtcactctccaaccaatatagtgatatgatctgaatatcctaaataccgagactcactgcccagaaacaaaattaaaattcaaaattatttgattagatcagtgtaattaagtctggacgaaggaggaaagactgataagaacaaggcagaacttctgtttctgaagaaactgagatatcctgaggattctaataccagtaagagaagatttttctctagaggagttcacaggtggatgaaaaggaaaacttgtaaacacattaaaatataatgcaaacaaagtgctagtaaaattatttcaaaatgatgtggagggccaggcacagtggctcatgcctgtaatcccagcagtttaggaggccaaggagggaggatcatctgaggtcagaagttcaagaccagcctggccaacatagtgcaacctcatctctactaaaaatacaaaaattagccaggcgtaatggcgggcacctgtaatcccagctcctcaggaggctgaggcaggagaattgctttcaacctgggaagaaaaggttgcagtgagcctagatcgtaccactgcactcaagcctaggcaacagactgagactccatctcaaaaaataaaaaagtaataaaagtgatgtggggtagagttagattatcagctgtctggtgaattatacaagctggcattgtctagttaatggcatctggctctcttaccatgacattcagaccatccaaagattctaactcaatctacgtttccagttttatctcttaatgtacagttcaaacttcattgtttacccctgtattatattttctccacttttaatttttttgttttattttcaattctacaaatctgcctttttgtgttcgtgtctctatgtgcctagttcctagagcccatctctggttgtgtgcatcttatcattcattcaaaataaaatgcaggccgagagtgagggctgacgcctgtaatcaaagcattttgggaggccgaggcaggcggatcacctgaggtcaggagttcgagaccagcctggtcaacatgatgaaaccccgtatctaataaaaatacaaaaattagccgggtgtggttgtgggcacctgtaatcccagctactcggtaggctgaggcaggagaatcacttgaacccaggaggcagaggttcaaatgagccaaggttgcaccattgcactcacgcctgggcaacaacagtgaaactccatctcaaaaaaattaaaataaaataaataaaataccaacatatgaagacttgcccccaaagcaatctttctttattttgttctcacagataattttgtttttatgtatattacaatagatagtgaattttaccttcttccagaatttattttgcatatgccattttaaaaaccatttcaatctatgcagtgagaaatagttaattacatatttgtatgcctcgtatcacctaacacagttctgtgcatatagtgtataataggtatttttttaagctggataaacaagtcaagatcataagtactagaactgaaagagagttttagagtagaattttagaggatcagtttctaaataaaaatgaaacaaggagaacaagcagttggagaatgttaaggaacatagagttactgttttctaggtccctgtctgcacatcttgcccatcctgtcctctcatctatgtcagtattctccatgaggtttctgaggataatatcatgaagtcagtttttagattcctagaaagttttattgactgtgtaacaccagcctgcatcagggaggtggaatgggatgggaaaatagtatcatgttcaagccccagtcacaggaacatgttaagtggttaacatctaagcatatcttataaaaatctatttttaaatatctataatctatagttccagtgactcagtggtactgtttcaggtatctgtaaatggagtgcttattttgtgccaactatggttctaagtgtttatgtgtaaaattcattaagtcttagctgtaatcctagtaagtggcattattagtcccattttactgaaaaaaaagttaatttatccaaattcatgcacccagtgaaaaatccaggtaggctggttcccaaattcatgattttaatttctacactaggctaggtccaaccagggaagacaatttcaaaatgacaacagaatggactcttcatattaatatttactcacctggaatgcttgctttcctgtcttgtcttctgcttgtgaatctccttgatggttctaagccataaagctttagacattcagcatttgaaaatttcatctgggaatgattgttatttttcaaaagtaactgattacttgggaccatgtatttgggactcactagaagtcttatatagcaataagcagtttcctggggacaaaataatactctcctaaaaatacatgggaatgagagcaatacagtgaagcagacttttaaaaagttttttacttttatttttaatttttatgggcacatagcaggtatataattttgatacaagcatataatgtctaataatcacataagggtgagtggggtattcatcacctcaagtgttcatcatctctttgtattatgaacattccaattgtactccatcagttattcaagacaccacatgaaggttttgcctcctttgcattctcaaagctttaatgcttgacccatgttggcatgattgagaaaagtcctgacctgtatcaaggtactgattcaattacttaataatatataacaaaggaaacatttaaaaaatactcggaggaaaaattcctaccgaataggtaaatcagtgcttagggtaaccctggtccatgatgttgtccagcaactgaggtttcagctatctgccattccttaggttgttgtcctcatctgtctgattaaaatgggctcaataccaccgtaaaacttttgaggccaaaagaagacaggaaaattagtagaaggcaacaagagtgattgaagagtcatgcatatatcacttttgctcacatcctatctactagaatttgatcacatggctacatcatgacaggagaaactgaaaagtatagtttctggcagggcagtcttgaggactcttactagaaggaaggaggaggaaatgcatattgaagccctgttacaggccattcttctggcatttcaagtatctgtgcataccatttttttccacgtgtagaacatattcagctcctccccatagatgattcaaagtctcaacaaatgaataaaatccaggatctctgggtcacacgcagttctctccatcaggtaggatgtttcctcatttgactacctataatacagaattatgccagttattttctctaccctattcccattgctgcccaaatatataatattcattggtcatgtctgctgggtaactacgataaaaactcccatctgcaaaatgagagtgagaaatacagaacaatcactgacccattcaccctatctcattctatcaggcaagaaatacaaagatatccttcttttgcataaagctacgtttcttggttagctcatctcactgtttctggtagtattctctaggattaactatcttgtctaaaacactttctggcacatctgcaggggtgtgcttgaggctaaacagcttttattgcttgctgttactggtgcaggtttagagcccaaaagttgctttagggttcaactacagcattgccgcagatcaggtttgtggtttcgttagtaacacaacatcaacaacaatgcccagatgacttctagttgttgttcttttcatcagtaaatttcttgtgcaagccacttcagtcctaaaatttagtctagaaataattcttaatactggtatgttttatttatttgttagattctaaatttagcttatcctcatctccgtcatctctgtggtggattacttgaagacattgctgagtacagaaaatttgatgttcaaataggtactggatattactcatttttaaattgtccatttgtacctgtgaccaaggttgctagctgtccaccaaagttctgtcttcccattccattgggaaattttcttttaaataagactccctagccagggactacatttctcccacctttttgtctctgtaggaccatatgacaagttcataccaatagagaatgagtgaaagtaatatgtgtcacttccagcctgagacttttaggacttgagactgctttctccacacttcctccctccatctagcagctgcaagcccaatgtcctggatgcccttggaatccaagtgctgaaggaggcaaaagatctcccagctttaagactgcataactgcctggagcagaatctatccatgcactaccactctccacaccctgcgcaacttagcctgttatttgagttagaagtactttactatactaagatacaaaagatttcagatttttcattaaggcatttgtgccaccatgggtaacatagaatcttgttcctgtatgtcaagtatttcccaggttaaaagttttattcgggagcagataactcaaaatctgaaaaggccagctatttgctttcctagattttttggcacctttgtgtgggtataatccacattcttctaatgacagtcatctaccctgaacttggttattggagccatggtgcaaattagggactgtggaggatccattctgggatgatagtaattgagcaacactgaaatttatggaaattttgtgagctatgcagtacacatttagtgaaataatttgggcttgaaaatagtcccaattgattatcttggcttgcagttcagagccatgactaatactctataggagatgattgagacaaaccgaaaataatggtccaccaattagatctaggcaaaggaccaggagtgacttttaaaggcattgttgagtatatgaaatttactttttaaaattatcatgagactaagactgtgaagtttttaggattagaaaaaatacatttgaactttttaattgggaaatgcaattagctgtcatttgatgtttctaccgagagaatcagtcctcaatgcatcattatttgctttattctttcctagcagctgaaataaaaaaaaaaggggtacttcgctattatttttagaccatgttaaccagaaaatggcactaaaatctgcgtactttctcaagaatattttcctattacgtatatcagtattctgagttaatgcacaagtaaatacctgcttaaatcaacaatttgataacacccgtaacacatcctatgtatcaggtgaagtaaatggtagaccagtagatttagtaaaggacacactaacagttcatttttgatcaggggaaaacattcctgtaaatcattgttatcacctttaatgatgacattcaaaaaagagacgtctacattgtgaactgtcattttcagttctcttttctgcccatccccaaatcttcctgaaacactaaaaagtcatctaaactgagcaacatttcactttttacaggaattttggaagttctctttccctttctaaacatgcagctttcactgtgcatggttatgaaactgattatttcagggaattaacttgtatggttattagcctttttactctttgatctttcataattctgagcctatataaggaatgaactatttaaatgacatgatgggattttacaacaagggaattagtaatatcacagaagaaattatgttgttcaattttaccataacattaatatcttaatttggtttaatcaagggatactacctaagagtaaatatctcagaaagcctctaagagaagattattaatattttgaaatataaaccacctaaggttataaacaatattaaaatgtaatagtctggctcatactgtaaattatagccttttaacttttttctttccttaaagatatacattttatggaatatagtaatatatatcacagttaatttcaattagcaatggtagtgacaacagaaatcctagatgaatgtgatcggtaaacaattcaaaaatctaattgaaacataactttcaaattccaatttctttaagttgtttatcagattcgttgcagaccacttttaactcaggattgctgctgtcatattggcagtggtaactaatcacttctctcatctacctttgtgtcagtctgggttcaatcagaagagagaaaaaatacagcattttgaacaaggaaaatttatttttcaataaaaaattatctacagtagggattggagtaatgagggattggctagaagtacagagaactctaaaggatttatgaatatccgatataatattatataatgtgtaataacaactgcctctagggttgagatagagtgcccaaggcagaggtcctaatcccccagttcccctgggctgaggttaacatcttgtagaggccatggtcatggcccaccaaggtggagaagtcactgttatgccacactgataggatttgctggaaatttaccctctgaggttccaggtctttccttgtaagctctcctctacaaaaatatctggggcagggggcggggctggaggggtacaggtgacaaaattagagcctgagcctggtgaagctggccatgttgctggaagtgggcaatctggggaaactgcaacactgtaggagctgagctctggagaatatacagacagtgcaggagacagacaccagacagcagcacatgctgcaagagcctgtgagcaaacaaaccagaacaaggaagaaaaatcctttttctcattcagtgtctgtcttgcatcatttgcaggcaaaccttgaaattgtgccatctgataaaggaaaagtattgaaagggcccagatccattttcatagggcaaggtagaaggatgcatttggagttgagtggcaggaaatgtattatcagcatagcatggtactgaaagtaggatacaatttctataaaattttaggtattactaagaccctatcttggagagtcagatatcatagagggataatgaaagtgaactgatgtgtgtatcagcatgcttgttacttaattctagtgctaccacacacatacacacaaaaaggattattttacatcgcagactctcactttctgcaagtgcaaattgaacaaattgcagtaaactcaccatttcagttacattgattgtgtcaataatggttggaagagtgctatatttaagcttactattctttgtaaatatgattagtcatttagaacaaataaatcattttttaatatagctactaataagaaaaaaatttcacagtcaaggaagagtttcattgtatatagtttttgacatatcctaattggccaaattatcttagttggctaataaacctgactctcagtaaagttcttcataatttccacagtttctcagaaaagcgaaattgattggggaacgtaagtcatatgaactaggcatttgcccaggagtcatatgtttaaacatgtccaagtacggggactacttcagcatgaaattatcatccaattcatcagcatttatttttttcattaggtctaaggtgtgcatgcatgtaaagctttgtaaagcattttaattaaagtaagtatcaatttaattagaatagatttaaattaattgcatttaaaaatcaatacaattagatgaagttatttctgattattgcaaaaagataaaggctgtgaaagtcatacaagattgttgaatctgcgcttgaattacttcacatcattacaataaatttaaagaaaacagctttctatggagttgttttaattatagctgaccttttagttattttaccatggactgagtaaaattatgctattacataaaaacccaagaaaaacagctgtcttatatagaccaagagaatatggcattgaacgaaaatataaggaggaaataattgaaagcacaattttcattagtggcacataaattttctgttaggaaaaaaattataacctctggacacctactaaaacatattaagttagcacccggaaaaactgtatgtgtaaatttatttctgaaataactcgtaaaaagagaatcgactatcattgatttcctttttgtactgccgtgttgttttccatgttaaagcaatataagggcttaaaaatgatatctctcatttgaacattgaagtacgtaagtgaaattatgtatctattgctttttgtgatttttaaagtctcattatttttagagcatatctaatattttgatttaatatctctcttttttttttttttttagcttcaccatgggttgataatagtagaactccaaataagattgacctttatgatgtacgcagaagaccatggtaagaatttttagctagccatgaaaagataaaataggcaagaagatatatatttgctaaaaagtcagaattttttattattaggatgagtattaactacttattgaaagtgatctgatttttaaaaataagtaaatataggtaaaggtaaatgaaaatgatgagttcaagtgggtaatgctaattaatataggtgaacccatttatcacattcatttcaaatggactactttaagttttatatttaatctcagtactacacctcttagctggtatggatttctatggcagggatccagtttgcttggagtagagctccaacagagagatgagatagagtaggagataatttgcctctggcagtgaactaatgagaattggccccaaggtaaaagctgcccctagttatattcatatagcttaggtttaattttttttccaaaatgaagacttatttgttcctcactactgaagcaacttgttctcctaacataaaactggaaaaataccaataatttgtaattggacttactggaaaacaactatttttgggttttttaaaactattaattgtatttatttgctttttaaaaatgtatttaatgtgtgaattttaagaaatgagttcacatatacagtataagtgctttgtatcccacacttttcatatcaataacttttgagtacatattcatgagaaaagacacataccatcatttgaatgaagactatatggaaacttatttatgaaatcccttattattggacgtttaggttatttctaacttttttctaggcttcagacaaattgcaagagcataatgtttgattccaaagacttgtatttagaggcttttagatgtccttttaaatatcccagtagcaatttatgtctacaccaaccatgtttaatagtgacaattattactaatttacatattcttcctgtggagccatggggctgttgagtggagctaaaaactaatatatagtcttgttttaattcaggaattggttgttttggaggagacttagaagctgggtgccaatcagtagaggcagacatgtcctgtcttctcttatcttcccactgagtggcatacctggaccagcattaagatactaggcatcagccaggtttgctgtccatgaaaattcacctgccactctgccactttaccttcttatcaagcaagggtgcaggttacaaactccaactgcttcctcaacacatagaactaattgtgctgtatgttgtctgaaaactaattggaaagttaactggcagcctcctgagaagttacatttacagtgatggcttcagaaataagtaaaaaaattgatgtcaggtgcagcccttcctgtcggagaagtcaggccccattccagtcggtggccaggcaacgtgagtgagcttttgggtcagtcatacacaatcaagatgatctctctccacaaccactgaaccatctgcataaatctcttctagagtctctttaaaatgcagagattctgattccacggggttgaatttggaaattaatattctgaactgattccccaggtgattcttaaacactgtaaagtttgagagccattgaagttcttggtaataacatcacatattgcctaattttaatctctttattggccagttatatttcttttttgttgatattgctttttgatgttcctaagcaacttatctattttttgtgcttattttttacatttaaaaatatgatagtctatttttcattaaagtgacttttaaacctgtggtcaacaattggagtttagataattgtttttccaggaaaaatgttcttctcaaagttaaaatatgtttcttcatcttctgttataaatatcaaaaaatgttaaatattatgcttctgacatctctattgttatattggatattgcttttatcaaactgacattgaagaatatgaatggaaaaccattgtctacttagatagaagtgggtctttgcttggggaaaaaaaccttgtctcagagtcagtaaatatcaattcaacaaatatcagtgtttgatattttggaagagaaaagcatttattacaatatttgtttcaggtacatccaaggagctgcatctcctaaagacatgcttattctggtggatgtgtgagttgttaaatactacttatttatatattgagaatatgggaggatttgtagataacagtagtatggtgggactaagaaaggtttgataggttaaaaaagaaacaaagaaaaattatgatgacttttatattcaggcaatgaagccatatcaagacaataataaaacaaattatttaattaaacatgaagagaatctatatggatattcatatattaatattacatatcatataatgttaaatatgaaatatattaaataagttaatgttggaacttgttcgggcatggtagcttcacacctgtagttccagctacttgggaggctaaggtgggaggattgcttgagcccaggagatcaaggttacagtgaaccatgttcctgccgctgtattccagcctgggtgaagagacaatgtctcagaaaagaaaaaaaaaaaaatctgggacttttaaaagtgaaatggtgatatacaaaaaataattccttgagtttttatgttggtctctttgttatagtgcttcaattcaagatatatgtgtatgtttgcaagtgtacatgttttctaataaggttgaagatgtagaaattgaaaagattatatcctgctatggagatttacttttttaaagagcaataatcaaggaattaaaataaacatgaagtgtaaaatgcttaggttactcatgtttttcctcaagagaagaaatgctcatgtttttccctgaggaaaaaaaaaaaaaaatctttgtctcattggaagaaacaaaatctagtaatttggggacagctaaatcccacaggcaagtattaacatttgaattttccccattttaagctcaagtaaaccaatttaatttagttgtccaaaccctcataacccagtctgagaaagagaagataaatgaattcaacaaatgtaatttaaatgttaattcttattttatttcttaagatgcatttaagcctcatgttactttaattaaattatggatcttatatgctaatccttgatattcttcttaagtataaatcaatatattaatgcaatatattataatcctgttggatgtataataatatccagaaataatgtcatttcaaaatctatagaagccaaatttatatcccaaacttgaaagtgtatatgaaatttaaatactattttcaaaaattctttcaacagaaatgtattgaggtcttcctacacacagtgtagtaacatagaaacaaagatgattaagacatagttactgagaccagacgtggttactcacacctgtgatcccatcacttgggaggctaaggcaggtggatggcttaagccgaggagtttgagaccagcctgagcaacaaagcaatatctcatttctacaacaaatacaaaagaaaaaccagctgggcatggtggcacacacctgtaattccagctacattttggaggctgaggtgggaggatgcctgaggccaggagatgggggctacagtgagttgtgttcataccctgcactccagcctgggcaacagagcaagagcttgtctcaaaaaaaaaaaaaaaaaaaaaaaaaaaaaaggagatatacctaatgtaaatgacaagttactgggtgcaacacaccaacatggcacatgtatacgtatgtaacaaacctgcacgttgtgcacatgtaccctaaaacttaaagtatattaaaaaaaaaaaaagacatagtacctgatctcaaagataattcaaatgtattaggtaaactagaccttaacaaataacaaaaataattgtagaaattaatagatataaagtatgacatagcactaaaggaatacataagagatagcaacttgatttaatgtatcaggaaagcattaaggagataaaattgggattgaatcctcatggctcatattttcaaaggcaagcatgggaggggagaggaaagacagtggaatttcaggtggaagaattgccagaagtgaagctgcacaggtaagtctggggacatttatggaggaggtagaggattgaaaatgcctttgcaaaattttgacagtgagacaaatctgacatggttgcctctatcttgtttctagcttcacaggctgattggctgctcattcctgggtgtgggccaagataactttgggagaaatttagtttatagtttaaatgataatagcccttccctaaaacgaaactgcccttataaaactaatgaaaggctaccaaattataggataagagaaacttgaattctactaagatgtagatgtagttaaataattactagccattattctggaggtcacaagatttgcaacttcccctattattcctgtaaataacatcactattctagaacctcagatggggcttttgagatatcttttcaggcttttgcatttctagcagatggtcccacggggacctgtgcctcaaccaatcctgtgctccccacccaaaagtgggctcagcacaagagggccattttccacacccctgtgatttcatcttcaaccagttagcagcactgatatcctagtcccctgcccatcaaactgtctttgaaaaatccctaatctccctccgagcctttgatgagattgatttgagtaataacaccatctcctgtctggcatgactggcccggcatcaattaaactctttctttactgcaatgccatggtctttgttagtgcagcgggcaggaagaacctgttgggtggttacagggaggagagagagaaaatgccaaaatgaaaggattggaatacagggctattgagatttctggctatttagtcggtatctatgagctgttaaaaatattaggtcaggatgtgtttctagaactttcacctgttagcatgtgaaggagactaattgctgggttgactggctattactgtagctcagcatcttcgtataatgaagactgagccagagaggagtgaggatggagaggggaccatagccttggaacacttaagtggaatgaataagggattttgcctgaatgcacaggaaggttgagagggaagaacaaattggatggctgagacatagactctttggtaccaagaacataaataggaatgaaaaatatgtttggaagtaatgtgtcattttggacattcagtcgtagtggttcagcaggcagctcgaaggataaaaccaggaaagtgttgggagctagagatgtagaagtgggggttagttgcctagagttgagccagccctgcacataggtgaagtcaccaagtattgtagaatatgtagaggaaagaaaaatgaagaataaattctagaggatatttactttaggatgcagaacaaggcattttcttgcaaatctgttatcataattgttatgtggatttataattattgttttaatcaagtcaaacaatgggttccctggagcaatgactatgtctattaatctctctactcctctcttctaacttggctaacagaaccgaatgagtgactataccatcagtatccatatttttttttaattgtcacttaacatgtaattttgataatttcagttagaaatgtacacatactgatattgggaggaaaaaaaggcaggatttcttataatttccacttctatcaaaaaatgtaactttttaaactgattttcaagggcaaaattattatttaaataatatataaaagatctagggtcagtgcatacattatctttccttatgatgttcttgattaaatacatgatgagtaacatgtatggacccatttgtctatttctaggagtggaagtgttagtggattgacacttaaactgatccgaacatctgtctccgaaatgttagaaaccctctcagatgatgatttcgtgaatgtagcttcagtaagtataagatgactgcattttcctgaattaaatttgcaatttctatcttctcctgactttaggtactttatacttttatcttatagaggctgagacatttttgatatattgcaagactatcttactgacctgtcctattttagcgactgatcttcttataattctttttttaaggttttttatacatattatatatatatattatatatatattatatatataatatatatataatatatatatattatatatatatattatatatatataatacatatatataatttaagttttagggtacatgtgcacaacgtgcaggtttgttacatatttatacatgtgccatgttgctgtgctgcacctattaactcgtcatttagcattaggtatatctcctaatgctatccctcccccctccccccaccccacaacaggccctggtgtgtgatgttccccttcctgtgtccatgtgatctcattgttcaattcccacctatgagtgagaacatgcggtgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatctgggttggttccaagtctttgctattgtgaatagtgccgcgtggatcttcttataattctatgccaggagcctttttgagtttctaagaatttatccctggttaaagtaattgaagtaatgactataaataaaaagcattccacatatcctccttcactcagaagagcttaaataagtaatatgagcccctttactcacggacaccgttgaaactcctagaaaatagcaacttggcagtatgattatatggcattttctattcattatcatcctcatttcatcttggacacatatctataatgtattatgtttttatagtatgtttttcttgttaacataaaaaccaatagatatttgaatgtgctcttattaaagtctcctcagaaccatcatagaccctcctactcatagctagaaagtactgaactatgaagcaaatgaaataagacaaacaaatgttaccatgtgtcattttaattcatagaatttaggcaaaatatttcatggccattttctggaagatatatttacacttgaggtaaatatattcatagagatgtgaagacgaggaatttgtggtaagggttattttgtattgaaaaatggatctgtctctgaaatgacttgggaggaagaagttaaagtagctggtctgaaattgatttactcaccaagggagactagaaagaagaaggcaggagactttgtttagtcccttctcacctgaagctccaggtagctagattattgatatttactaggaggaagagaatttatccctgaaatgtttttagtggtgtatcgcggcctaagagtaggtataggaaaacacgatacctataaggcaaggttcctggcaaaacactctcacaggtgatataattctctggggaataaactgtaagtattttataatttacaaggagccctgtgaaactctttttgtgatttcccttcatgtgggcaagaagaatgtgttcagcacaggaaggaggagctgggaagccctcctccgtgtgaggcctctatctacttcatctgaaccttcagaagtcctttagcttgtctatattctcaacatattctcaacattatttattaaaacttgatactgcataagatctctgattcatttaagtctgattttacaatctatctgaccctgtatgtcagctcactacgtatttcaacagaatgcaaacaagtagaatgtaatacttgatctctcaaataagatcatcaggaaagatacttatttggctttatttgtatataaacatatagttcataacaaaccattgggatagttctttaaaaatactatctgtggcatagcaaaagagaaagtcttaaatccagtgcagatttgacatctaggtgaaatttatataaaactagcagatattcaatgtggtgaatgtcttattctgacttcttcgagaagctgaatctcacttgcagattcaaatataaatagtgtatttgggaggtgatcacaggaaacactactacttaaagaagtcaggcagtggatggaaggaaacaatgacagaatcttactttaatttaaaggaacttaattctctgaggaattctggaagccatacgtaatattcacttcagagttaacctgccccaaatgcaaaggagctgaggttttaggtagcagccttccctgtgtgtgggaaaaacagactgggcacaagagggagtactgaaacaaaaagttgtaggtgctggtagttagaagcctggcccaggatccagtctatccagtcaatgattcttaaagatggagactggtcacaatctttaaacaaagaaacatggaacatcaggatggtggacttctagatttagaaccaaggacataattcatactcatcttttctttcctctaatacctttcctaatttccctgcagccttggccaactcctgtgctggtggcttgcctgataggaggaaccagactcttactcctcctggggcctatgaatccatggtttctgtgcccattcaaatggtggtttctgcagttgtccattcacagttatctccaaccacagacatacttgaacgaatcccaagttccctcttaccattatgtagcagcaacacccatgatattcctcttgtcaactggaaccctgccagtagcatcacttattttttttttttcttgtaggtctactggcatgagaattgaagcatattcagatagtagctatagatttaggtttagttaaattctttctgggaccctgataggagcactgcattacctgcccctttcccccaacacatacacacttggaaagcagaacatttatttcagtggagcctgaagtctcaatgacaagaagtacacctttcccaagtgggtcacttttaattatagtaagaggggactttcctactttacccccttggttttcatattgatacattctgccttttaggggcaaagccaggggggtggaggagaaaattgatgtgtagcatttgccaattttcatgatgcaaatattcccactatgaccaattttaagctaccaatgtgaggttaactggcttttaagtttcgtgaaaatttcaaccatttttaaaaaattattattagcagttacaagctggcttcagcacatagcaccatggttcaaaatacatatcgcattttgaagacaacatccccaaatcagattttcatctgtaagctggagccttagttgtacctttagaggagactgtcccaatgttatcaggctggcagcctctagtgatgcaacatatggtagaccctgtgagtcctgtggtcatgtgcttattattggactccctgtactataacatgtgttgcttagtttgagatgttattcagtatcccacgataaatcagtcagtatttgtgaacctgaggattagtgatacttgatgacacctcatctgtgaacaagaaaggggaacccataactggaatttgtatccataataggaaaaacaaatttgaccccttctccaagggggtaaaatgcaatataataattttttacatcgagttgctggttgctttctttgagaagtggtactataatgaggactcagcatcacactattcccgtgggttggttatttaccagtggcagtagttgcatcaaactggaggagcttttaggcccatgtgtatcctctctctctactatcaagctcctccattcatgggcctattttgcaagcagtacagttgacacatacagagctggatgatctccagtggacagatcatcttatctacccaattgtttagtgccttttctgtgacgaatgttctctagcacacattgatgcaaaacaaagacatctttatgcttcatgcctacctccataggtccatcctcatgttgcttctccaaaactatgtatgaggaacatcttctaatcttgatccttttaggactttggacaaccagccatgccatttataactgtataggagtccatgagttttctaattgtaggttacttattttccacaacatattgatggccagttatattttgcctcaataaccctaaacatccattccctggcatattatctcagtatcttctggttcatattaggcagatcctgcaactcttttgttaaatatcttcttttgttttcttggagtagagactgtacttttcaaggtgggccgtgttgatacttggccttttttttttttttttttttttaacttttgagtaggtttattgtcatgtaaccttttgggattctttcctttttttaaaaaattatatatatatatatatacacacacacacatatttattatactttaacttctagggtacatgggcacaatgtgcaggtttgttacatatgtatacatgtgccatgttggtgtgctgcacccattaactcgtcatttagcattaggtatatctcctaatgctatccctcccccctccccccaccctacaacaggacctggtgtgtgatgttccccttcctgtgtccaaatgttctcattgttcaattcccacctatgagtgagaacatgcagtgtttggttttttgtccttgcgatagtttgctgagaatgatggtttccatcttcatccatgtccctacaaaggacatgaactcatcattttttatggctgcatagtattccatggtgtatatgtgccacgttttcttaatccagtctatcattgttggacatttcggttggttccaagtctttgctattgtgagtagtgctgcagtaaacatacgtgtgcatgtgtctttatagcagcatgatttatattcctttgggtatatacccagtaatgggatggctgggtcaaatggtacttggcctttttgttgtctaaagccattagatgagataggatcagatcatgaggaaagtatgcatcatcttttatggtctctaggaacgcagaagctactgccctctaactaagggtcacaggttacttttgcctgtccagagggtataggggaatccagaattttatattctgaagtccacttagatgtcctcatcctagtacaaagggtgcttctccttgcctattgatgttctgacttttgcatagaaagctgccaaggttgtgaatgcagcgtactttataattctgagattctcaaaagaaaattctgagccaaatttctagcacatgctgaccttcccaaaatgggaaatgagaatcttttaattagttgccacacaggttttctggctttcttactttggccttagttgatagttggctgacataaggctatcattttcttcagtgaaattcaacaaccagccaactcatagttttatgattactgttgtccccatgtctctcaaatgctaggtgcatccccattaatcagtattttattctgatcactgcagatgaaaatcttagcaattgtgttgccatagcatctgaggagttttttgactccagtgatgactgtgcccccaggtacaaatagggtctttgttgccgtatgtaatttaggaaatgattcagttctggaatcccattctgaaggtctgcttactaagaacactggttggtatctgcttagattgattttccccagaatagtcactgagacaaggattcaagcttaaatggtttatttggaaagtaactctaggaaagacttagagaaatgtgggaattaaaacaaggcagagaattaataaatgattcatcttcaaacaagtttccactgtgagtgagtgcagcttatttctctgggaataagtatagatttcatgaattagagttatcccttccaaggggaaaaatatgctggagtatataaagttgatgactattcccaagtaatgttaattctctggcattcccagaccaccatgtgcaacagcagagggttccctgcaatctcaggcagttaaaagttgggttgacatgaatggaaaaatggatagggcatcaatatcatctagcttgattagaaactgaataatgctatcaataaaatgctttaaaatgatttctgattaagcaagctttgaatgaattttatactgtcaacatttagtcagcaactaacatttatttcctaaagaacttagaatgggcattgggattcttaaagcctgccagttttaaaggccattgattttcctaaaaaaaatatgttgttaaacgtgtatttatttgaagaaaattgttaactaatttcttaagaaacacaactgcaggatatcttcttgtggtttctgtgaaccaggttaatacagactttactgatgcactgacagctctttgtaaatcctaagctgggtgtactcatttggtgtggtttgaatgtgtgagctaaaagcatatgggaaaacagaatatattactcgtaggaaaaactgggaatacatttcacctggaagtatgcacctcagtacctcaagttaaaagttattaaaatacctccattaatatgtcataaacagggcagaaaagtaatattgaaacacgcacaattaatggaacttaaaagataaataatcaggaagacatttgaaagatgaggtcatagtgactttccactctgcttctggagatacgtattactggtttcagctcctggtattactggtcccagctcctagttcctccttaggcttaattagttttggttacttatttacttgtttatggctcttatttactataaaaatatcatttttttgtcaactacactctgaagttttgttaactgtacacttttgtttaattttattatttcaaaataatcattaatacatttttatgattgaaaactcactaaataattttaagtgattacattgagacatagatttgctcctcagaaaatcagtacaaataaaatccaaagtaaacacgtgttcattatttttgttatttgtgcattaaccttctatttaatcataattgataggtaattatttaattttttttttttttttttgagacggagtctcgctctgtcacccaggctggagtgcagtggcgccatctcggctcactgcaagctccgcctcccaggttcacgccattctcctgcctcagcctcctgagtagctgggaatacaggcacccgccaccacgcccggctacttttttgtatttttagtagagacggggtttcaccctcttagccaggatggtctcaatctcttgaccttgtgatccgcccgcctctgcctccgaatgtgctgggattacaggccatttaatttttttaaagcaatgttcaagtggcagacactgttctaagtgtttttcatagtaatttgtttagtctttacagcaaccctgtgaggttgataatactactattcttaatattgcggataagaaaacagtagaaaaagtcttagcaatttttccaagaaaagagaaagaactggagtgtagccatcttcattcatgattctagatttaaccaaaaagttatgaggctaaatcttcaggaatatttatttactttctttaccgtgtatcttttgctcttatgaaacttcatatattcttatttgcatttataatctttagtgtcaaccacattatatataatctttagtgtcaaccacgttaaattcataattttaaagaaatttttcagtcttatgagttagtctgctttattttgagtatatactgtctgaaattgatacaggtaaagagaattgattcttatgcaacattctggtaagaaaaaagtaaaattacatttttatctttaacatataggcccttctcattaaatacagatttaacaatttactgatatggaaattctcaggaaaaaaaccttcaaaatatatttataatgtcaagttgtatgtgtgcgtgcatgtgtgcatgtgtattttattttctctctaaagctgtttgaaagtccaggaaagcaacaatatacctttagcttttgtaacttcaggaatccatagtaataaggcactgaggaaggagggagtggttctatagttaactttgaccgtaatttttccttagagacctcatgcatttctctttatcttcatacccaaaagaatgtgggtcatccaaagactcaggatgcaatctatattaacactttcccaaagttgcccagaagccaccaaacagaaaaatcaagtagcctctcatttttagggttatttttctaagtttctttcattctttttaaaaataacagtaatttttcatgcttaaatcatgtataagatgtcagaactaacgctgcatcatttctgagtgtttctactatctccagggttgttctttgttgcagaaaggaagcctgctgttagcaaagctgaaatgcaagcataatgtagctgttttcccactaatccagttatatgctttgataggagtcagtggtagatgataggagcagcaattcaatcacagcgtgttctgatttgcaggcagaatttcaagtgttgacacagggatttgaatttgtttatgaatgtgagggagtttgacattttaggagtaaaatactgcaagccagtggaggatgatgggaaaatgtatatggattgcagacaatatgctaaaagttaacaaccaaaggagatcttcatgtcttttaataaaaccacacatttcttactaaagaattagatgcacatgttatgattatgttaaggatctttgagtcagttttcctcgtggaagcttttccaattcacagtcattataaaatactgtctttgattttttaccagaaaaaaaaataatcaaaatataattccttatatctttgctcttgcttgtaggaaataactttttaaaaagttagttgtaccttttgtccagattgtagtcgctaagcagcagtcctagaagtgacagtttataaatgtaagtacaaagtcaaaagtgaagaaccatagctaaataggaggctggaaaggaaggtgagccctttcccagctggaagcttttccctaaatgcaactgctataaaagcctgcagatttcctgggtccagacctctgtgtgagacaggtctgtgcttattatttgtctatataaacaataattctgaatatggtattctaaagattgtaaaagtctttgcttcccacagtatgcggttcaaggagccaatatatgttggtttatatcaagtaaagagcaacgcgatggaatgatcctgccaacacgttatccctgcatggacagtgttagtaagctcacatctggtttgactcattcttcacaggcaaccctgtctcttagatggactggtagaattgcataggaataactgtgcagctttggaaactactagttttatgaccttacacaagtaacctagggcttctgtcagtttccttatcttaaaaatggacaggataatttaacttgctgaaatgttgttgagtaccaagtgaaatgtcacatgtaaagtgcttatatattgtaatcatgtattatgatgatgattattgttatttagtgtcatcttccaacatttttccaccaactgttgggagacatttctttatgaatctttcacatttaagtctaagcattaacagccaatttattcagatttatttgcattccaggatagtaaagagatttctccttctcccgaagagattttcaatgcagagtaattaaactattgtgtctctctggaggggaggatgagtgtgggccatcagaagcccctgtataagatcagggacttcctcatcttgggactcctggctggaaacccatctcactacctatgcaggtgacccctggctgtcctcctgtcatcctgtgggaattgaggtttgggcagcttgtgcaaacaaagatgttactctgctcctctgttgctatgagtaataaactctttgtctctgactcagagggcttgtattttttctgccttttatctatgacactgtaggaggcttacttgttagcttacaactgctataaaatctcagacatttcagttcctgacttgattgtttaacaccaactaataccagagcaggaggttgtttaaatatggagttgcactgtgtaggcaagtaagagatgatttcaattgttccatttcctatgtgctttaaatttcagatttccttctaaaatatgcctaatgtattcctagacaaggacatgttttgttggcttttttagataaggaacttcgctactcagcctatgaaaatgagtacaattgtaaattgctgcacaatttgaacttaaaagcaatttctatcccccagtgctaaaagtttcttagaaaacagaccctctttttgccagagctcaaagaaaataaaagatatttgccatgtcaatacagttttgtgacaaatctaagagaataatttcttgtcttatcaaaagccatccatctagagttcaggaaaactttatgttgatctattgctcatttatgtcaacaagaagactgcagtttattctcttgccatcgaagtggggcctgtagccaagcagtctgagccttgcctgggagctctgttaagcaatgggtacaaatgcagcatctcaagctgcactccagagctaaggagaacatctgcatttggaaagtcccccgggtgattcctgtgcaggggtttttatcgcattactgttaactgtgtgtacaactggcgggctttgcgtcattatagaagaggaaatcagtatactaaagaggtacctttagcaagttcagcagatgattaactggggcttgttgtaaataatcatgtttttcactgactcagattttaagagcttggtaattatagaattcttaatactatggatgtttgaatatttttattttgtagacatttgtttctttggggatgggaggaggtcttaaaacaggaagaaatggaattaagagaatttgttaaaagaagaagaattctatcttcttatgcactttttttaggtaaagatgggacctttataaaagtattttcatttaaaagacataaagaaattatggacagtaagaaaagatcaaagaaaaggacaaatttagttgttataatagcagggcaaagccgccaaggttatttaggatttttcttttttttttttttttatgagttgccagaagataacttaattgctttggaaatataaagagagtttataagaaggtgttgacaagtacaataagtatttttttcccattaattacatggtacactaagtttttggcacttagaaattcgtcgtatatgtaaaaaggaaacagcaaagtaatattcagggtgaggcaaagggaataattttattctaaactgaactattgtttttagaattataaaagttattgacttatttgatggggcttgaaggactaggaaaagatgtcatgtatgtgagtacttattagatgaaattttttaaattatagtttcatttaattttgagtgtaggtaaagagagtgacttgggctggcctgagcaatagatgtaggagaattgttcagagttctttaaattaaattaaactatcatatttgttcttaattatttagtaggcttaaaattcaaaagaaattcaaatgtaaattgacactatgagaacttatttgtaaaatgcatacactgcaatcttaattgttgaataaaaatctatttcatcaaattcctagaggaataaaaaaagcattttgagaatttcgatgtatatattatagcttgaaaactaatatgctaagacatgaaaatatttttaccttatgttaatgtataagagatttttcataaagtgacaatttgtataagttctaaacttcaaataaaaatattggcaattttttctacaactaattcacctttgtaatgttttgttcagtaatccatgtttattgcacactttaaaatatattttaaaatgttatgaaatctctcctgctatgtagtttgataggtatcttctttacctatctttttgtcattaatttatatcataatcatgctctaagttttccagatgtatataatttgtctcagtggaactgagttaaattgaatataattccttcaaccctagttgataactgtcatcagctgtttctgcatcccagatacaatttaatgtttataagaattcattggtgatgtgaataaactttcttaaaaggcggatgtatcctttctgtctagtgaatgtcttgtagatgtgtacagatgagaaattacttctgcttaccattacatgaatctggatgcttccaggcctagatagctgcctgatcatcccccagatcttcccccagctcaggtctttgctcaaatactgcgtgatagagaggccttccctgactactgtctctcagacagcattccgattttagttattcaaccacttcgtttatttaatatttcacgtcacttcattttttctatcatttctcttcacctgatattttacatatgtttgttattttctatatctctgtattccctcctctccaagaatgtacgcttctttgagtatagagagagtcttttttgtactaatgttactgtacatagagtagttcaaggcacgtagtggtggttcttgaattgactctaccttttgtcaatcagaacagtgctgaacaaaaaatgtactagatggatgtcagaattttataaacagtttcaatcagtgataagttaactttgtgttcttatgtggccagtcatcctcactcatatgatcagtattgtagtatctctgctctacaaacacattagttatgtatgccattcttattgtgttcttcaagcaaactgagccatctgttttagtttatttttcaactagggaattttccaagtactcagcttcaggtatcatgaaaatattgtacatattggtcatgtctgcttcacagtgttggtaaaggggaccagatcagacagtatgtgattgtttcatcatttcattaaggttttgtcttcaggagctggcattcaaatttctagagggctatgcaaaaaacatttgtaatggaaataatactgataaggttattgtacctggagaatgatggagtgggaaagaaagctgcccatttttccagttggaaaagtgctgtggactcaggagtgcacagtggttggttaagagatggttgagaagacagaaatgtcaggtggagatgcagggggatcctaaattcagtttacatttcaagtaaaagaacagcatactttcaatggcttcaaatgtttttaaatgaatatgattagagaattataaaattttctctatcaaaatataaaaagaatatattaaaaatggtaattgggacttattcagaaatccatccaagatttcaacaaggtaaacagactaaatataggttacatcatgatttgagttgtttgaaatatttgtttaaaaatgaaaatatttattgaaatgtttgatgaatgatgatttacatttataggcaaacacaattcgtgtctttataattatagggaattgtattccattttatctactggtgccattttttagacatatacagaatttattccatatttacatttttgtcctgattgttaaactagctgatgtaaattatataattttagaatttgaagggctttccacctaatctagaaaaaccctttatttcagaaaggagcaatctgcagcttaggggagataattgaatcagttttggctgtaatgcttattagaggcaaggcctggactagacttggttttcctaaattgattaaagaagagataattcattctcaatatgtttctttttttatacaatggaccaaggaaaccgcaaaccagcagccactgttgggaacagcaccgtcaacttgaagagtggagtggccaactccatgagtgtcattagtgaagatatttatgtctctgactgtgagagggtgaccataccttctagttttccctggacagggattaacgacagaaattaaaatcacattcacaacattagcaaaagtcatgaattaactagcagtacttttagtaatatatttaggacctatattaaagatagagaaaagagtgtgagagatatatttaaaagatttgatatttggaattaatgaataatttttcctggaatgaaaaggatacccatgtgaagatagcagtttttctaatttactcatgagagcaattttaatttgacaaaaatttctaaagttactgcagtaggaagacagttgtgaagaatatcacatgacgggatgtggtagctttctcctctgttattaaactgtaattgaaaatgattaaagaccttagagaaaagtgcgtcagggaatttgcgcttggggttgagctctgaatcttggttgctgtttgactctgaacactttaacatcgtacacctcatttcctcaactatataatgggaagcctattaaaactaaaactgtagcttgttgaaagttaaacaacttaatggatatcaagtgtttagcctggcacgcaggtgattctcaatacatgttagctaatactttttaaaattattcatattaaaaagcaagctcatgaaataacggagggacaaaggactaaaaaattacagaaatgtattcaaaatcttaatttgttgtaaggaatgtatcatgaatgaatgtatcataaatgggaaatttcgctatttgtaaaaacaaattgcctaattttgttatcacctcatagtgttggggaaactaaattccaccatgactatataccaaaacccatgaaacatcagtaaggttacagatgaataatttcctgactgatagacggttgattttctaagtacaaaactcttttaagaaatagtaaaggaataggctcataggtttagattaaatagtaagcaacaatctggaaaaacagaactacacaaaaattaatatatgagaagggtcattttgctagcaatcaaattcaaatagttaaaatattgaaatatttttatttacagttcagcaaataaaaaatgggaagtgtttatgaggctgcagtgaaactagcacatatatactttaaattggcacaaaatttttggaaagtaatttggtaacagataacctagaaagcatttttttctattaatctgggcttttctattcatttattgacttctgaaattcaaagacatactaaacatacaaaaatgcagctaagtcacagtagcaaatgaaccaaagtcctgactgcagttataacatttcacccagacattgaattctaaacagccactttataaatcttatttcttatcagttttccagaaataactcttaactgggaatgtatccacatatgtaagaataaatgttatcagctattttatccggattttagaataatcattttcatataatctcttatagtccaaatctactatgaaaaatatgaaaatcaaaataaattttgaaagttttttaaaaataggaataagtacataaaacaagcacagccaaaattttggagcgcacagcctctggtcattttccttttattttcctgcattgccatctggtggccaaaatgtggatagtgtctgataccataatttgtgtttgtacttactaatatgcaaaattttattgtttcttatttaaattatttaatcttacaaaatataaatttgttgtgtatgttatccatcatagttaacttgtgtaaataagtgtactaatattattttaatttaaaaaatccttttccaaagcagtcaggtctggatttgaattattatttttgctgatgattacatggcttgagccaacaattttgcaccattatttattttacatgccagaaatagagaaaataaaacattaagacatgttaagtaataaatattgaacaattttttcagaaactatagttgtgtcctatttttgcttcttaaaaatgctttaggactaaacaatgtacaaagtaccctaaagaaagcctgcctttaaacatttagaatccatacataggagaacggtctttctgaggggaagggatgcgaattaatagacatgttgagagctggatacagtggctcatgcctgtaattccagctgcttgggaggccaaggtgggaggatcacttgaggccaggaattcgaaaccagtctgggcaaaatagtaagaccctttctcatttttaaaactaaaaataattttaaaaagacaggttgagtgggcaaataataaatgagctacttctctttcactgaagtttcaagtagaatatgtgaccttaagaatgtcttttgtcattaattcttaatgtttccagtgcagaactacttgactgcactaaaccattcaaaggaagacttggtactccaagaagatgtgttctagttgccatttccagacaaagggcacttcccgtaactttctgcttctttgacttgtagcgtgtattaaggcaacaggaatatttcattgtttgtatcctgacataatgtgatgacaagcagagtccctcttctcagaaatattttatggaatgatttcatattcagcaggggaaattagagcaaaaatagagactgcctttacaaaaccaaaagcttgggttatttcatttgagatactgatactttgttttgactggaaagcatctttcaatttgtgtacctgactgggatatttaataagaagtttctttggaagtattgaaatgcattgatcatagttttatcagaaactgtttcaaacaccaaactaatgtttgagggacacttgtatcatcctgttagtgaactttatttcaagctcaatacagctgaggcagtttatctgaatcttatgaattaggaatctgttctaattttagtactgagtatcctaatcctttttactaaaataatttttaaaacaatagagttgccatttaacatctactgtatgtcagactctatgttagatgttctgtatatctttatttgagtattttaatgtctatttggacagagtatttgtacttttgaatgtacaagtttaacaacatattgcagagctaagatgcaattcatctacttataaatctatagcttgattattgattaacattttacactgacttctaatttccatagtttgattattgatcaacattttatactggcttctaattttcttaaagtccacatccaaagagtttaaacatttatccattattcatttattcagtaaatatttatagcatgtttattacatgccaagtacagaaaatgcagtggtggtgtggacatattctctggccatgtgggctaataatccaatagaggggtctatttattaagctaggatacagagaaatatgaaattataactggtgctctgtaaaaaagagatagatttaagagagcttagtattgggtgacttaatctagtcagggaaggtcatgaaaactttcatgaggactgagtgaagaagggagaaaaagtattgtaggcagaggaacagtacatatagtgggaaaaagtgtttttggcagaaggaacaagagatgtggaagggcaaaggaaagaatgccccaatgctggagtagaaatacaaaccctccaggatttttaccccagatgcccatgttaacacacgtgccttcctatctaaacaggctaacagaaattgtcctcagcagttctaatgagtgacctacttagttgaattttctgggattggaaaaggaatcaatgtgatgttagtttggatttctgactctgtcatgttaaatacacacttttacaagaagtattttcttaattgatgaaaaaatcagagctccttcaatctcttttcactcgccatataccatttcaaagttctgtaatatatttgctattacacttttgctctaaggtttttaatatgtggttttaaattagtatgtaggcacgtgttatcaaagactgccacttcagcccatgaaaattaacctatttttaaaacatacataatacgatataagctgatgagtctaagatatctgtgaaatatagtcttatctgattgtaaactttcaaatttctcatcactttcctaggagagtaagatttgctatagggagttatactttgtaagttattcctttctgtacattatttgtgagttttactatgagtgcaattatagtaattctgttatacactactgaatatatatttaatgaatgaatttacatttaatcagtttgtgttaaagtcacttaatgagatgcttcacttttctgtgttaaaagcaggtcaaggccaactgaaagactctgagcaatacattattcagtgctcaatttctgcataacttgtacctttatggtgattcatggtttaaataagtcagttaataatatttcctgtaaccatttctaataattctctaaggtcactttactattaatgtattggcaaactgtatttttacttaccaatacagggaaatgctaacatttatttgttttgaaaatggaacatgtagaataagcttgcatccaataaccaaagaatagaagagtgataaaagaggcagtgggactggtcatttggacctgaagatactcagttttcaatatttgaatttatagaaaacagtaaataaatatactggaactttattctcacactggtgatattcatgaaagtcttgttcaaaataaacatgaaaaaggacttactatctgtgcaggacattttacctcttgttttttcttttctctaagccttccttctcctctcattatcctgatcatcttgcctcattgttaaaggagacaaatgccacagacagtaactatcatcatccaaatccacataccacctggctcggtcagcttccactcttctttcctagaataatgaagttgatgtgcattttcctaaagggccattcctctgtgtgtcacctggatccatctgtccctacctttcgacgagctttattttttacctctcttctatttcctgcatctttttcttccttctctctttaacaccagtcttcttatgcttgagtgacccctagctttaaaatagacttttcttgacccccagtctaccctacagatgccaccctgttttccagctctgcatccagccaaggcactttgcagatttgcctgcattcagatgctcctgctgtccattcgttctgccctccccacccccccaacccaaggctgcctacataatgtggatgagttcaccaggcatttttttgtttgttttgttttgttgtgtttttctgagatggagtttcgctcttgttgcccaggctggagtgcaatggcgtgatcttggctcactgcaacctccgcctccctggttcaagtgattctcctgcctcagcctcatgagtagctggcattacaagcatgcaccaccacacctggctaattttgtattttttagtagagacggggtttctccatgttggtcaggctggtctcaaactcccgacctcaggtgatccacccgtcttggcctcccaaaatgctgggattactggtctgaaccactgtgcccggccctactgggcagttttaagtccccatcttccctgtctccacacagtgtcttccttttgacacatttttctctcatccaaaacagtccaatctcctgatttctctcctgtttccatggaaacttgctcttacttagttttctcagggactgctattctactctacttttttttgttttgttttcctatggctttaaaccatttttttttcctgaagccttctgtttttttttttttttttttgaataaattatttagccaagacttcttttgagcctcatgctttaaatgttatcatttcttgacatgtacacttgcatatctcacatgtattgaaacctcaccctaaattgaactctgtgcttctcttctctattcctcaattatccctgaaccagtcatccctccagtcctctatccttccagatgcccatgtcagaaacctggcagttattgaagataccgctctgttatgcatcctcctgctaaatccaccaccaagtcctatttgattctttctcagaaatacctcctgaattcttccctttctaaccatctccacaaataacaaaaccactatgtattttcagctaggttactgcaaagccttctgattactctccctgctttatattgtgctcatctcaagtccattttccacacagcagctaggatgcactcttaaaattccagattcaattattttacatttggcttaagatcttccagtgactttccatttcacagaaaataaaatcatcttcagcatttccattagactccacatgatctagcccttgcctccctctctgaactcattttatgtcttttgtcctcctatgagaccgagctaaactcactctctttatgttttcttaaaaaggcttcttttgtctccatgtgagggcctttgcacatgttgttctgtttgcttggaatgttcttcctttgtgctcttcactggaacatttctctggaatcacaggaaatgccttttcttaggagaattttctttcaaatgtttgcagtccaaattagaaatgcctctcctgatattgtcttctagagcataatattatattgctttatagaatgaatcataatttattatactatattgagaggcaatgcaggatgagtttttttcgtagataaaatggggataatgataatgtttatcttgcagagcatttgcaaagacgaaatgatttacatttgtagaatatgtagtaaatgcagcacatagtagacactatataactgtttatatatttatggtatttttgtgtgtgcagataattatgtctgaaagcataaaactactacctgccatgattcttggcatataataggctgctagtaaatatttgcttaataaactgatgaactgtgcaatgtaccttataattacgttcagtgatcttcagagaaaaaaatgatgaattatatttgcaagaatatgtaataacttatgacccactcattaaaataagtatatgtttttgatgtgaaaatatctttaacattttatctggccagtcccttttttctggcaaatatgcttttttttattattcccattctgcagatgtgacagtttaggtgccaagagcctgaataactttcacaaattacagagttaataaatgattggatgactccactcatcctcttatcctggattttgttgcagcattcctattgttctttctttttggaaatatccagggaacgatgtgaatattttttatggggttgacgaagttactttgatgatcgttcttaaattttccattttgggcagttatcgttggagttgatgttttctctcccacagcctctctgctgttcagggctccatcaccttgcctccaaggttcccctggcactctttagtaacctctaaagtgatatttctaaaaggctaccagttgttcttgattcagattgctttcctctgttagcctctgtagaaagacagtaccatcagatttcaaaatgactaaacattgattcatgttattcagtgtattacttttccaaccagtctttcctaataagaggcaatgaaaatatttaacatgtccacacaaccagggcaagcatcccatatcatttctggatcctgcatctatttcattgctttggattattttttctacatgctcattaaatttgagaactagaagggatgtcatataatttaattctcaaatttataagcagggaaagcaggcttcgggaatataagcagcagactcagcgttccagtatgggttggtagctcagatgaaaatagccattggtttcttaatgcacctttgtcaccagcctactcacttttccatttgaaagagtaagcaatgcaataccgtttaggagtatcaaacacaaattctatgaaaactatatggttgattttaatgttcatttatatatttactttttaatcttttgcagtttaacagcaatgctcaggatgtaagctgttttcagcaccttgtccaagcaaatgtaagaaataaaaaagtgttgaaagacgcggtgaataatatcacagccaaaggaattacagattataagaagggctttagttttgcttttgaacagctgcttaatgtaagtatcatgctatgtcttttgttgttgttgttgttcaattgtagtatctgaatttcaatattctgatagttactactctctgggattagatagtgctgtttttcatttatttaaaacacagatgtgtgcaggcagaagaaacctttgaactatttttatctttgaatttaaaattcaaaaggcatctaaaatgtagatttttaagtttttgatattttttatctatgttttaaaaaaatttataaggaaataatttaattttgaataagcacttgaaacttaattggcctatatagaatatcattactttttcttatctcaatcaccacagtatttatctgtaaccttgcactttcaatcatcaaatggttactgagaacattttagttttaaacatctagtttgggtctttaaattgttcctaaaatgtacagaaagttccaaatggtagacattaagatgaacagaaatgcaactcccggagcaggaattctttctgagtgaggattccccacaatcactcatcagtgtctagactgtcagatactggcgtgcttattgccccatgttatagcatgtgtcttttttttttttgaaatggagtttcactcttgtcacctaggctggagtgcagtggcacgatcttggctcgttgcaacctccgcttcctgggtgcaagcgattttcctgcctcagcctcccaagtagctgggattacaggcacccgccaccatgcccagctaatttttgtatttttagtagagacggggtttcaccatgttggccaagctggtgttgaacttctgaccccaggtgatccacccgccttggcctcccaatgtgctgggattacaggcatgagctaccgcttccagccttatagtgtgtgtctcatactgtggactagtgtttttaaattgccttgccctctatttcactttgagttacttaaaagcagggaccattgttcaattattttatttcttactaggcaatattattatcatgtttgagagtaggaaccttacttctctgcaccttggtttccacttgtatgcattagaggtcactatgacatgtacctcagagaattgtgcataagattgtccacggaacctggcatgtagcaaaccacacgcaggtgtaggttgctgggtggtattggagtcatggtcattattgctgtaattactagcccacatctggtaaaaagtcagatcataatgtctgttaatatttgctgaatcactgaatgaactcttatatttgatctttatgcaaatatgagtttgttgttcctgagtgaatattctaaatagtttttgagatatccaattgggtgattcatttattcattcagccaaaatttattgaatgcatcaccatttcctgtcatagtgctggtgctggaattatagaagtaaacaggaccagctgctctgagtgctaaatcatcatccacagaacagtgtgcaagtgccattacaggatatttagcgtgttccctgggacagcacagaggatgggcccagctcctcaaaggaggtcaggaaaagtgtggcatttccgtgaaaatgaggttttgaagaatgattagaacttaggtaggtagaggaagggaaaattatttcagaaaaaggagcatattttagacaaatcacagaagtgtgacacaacatagcacagtaaaaaattgcagatggctggcatagttgggacatgagcaatataggaacttgatggaaatggaaaggccatgaggtatcagttaaggaagtgtttaggggcaaaggaaaactttatagtatggccttggagtgttctaagttaaggaaggtattcgtagagatgctggtgtgggaatagaagtgaggagctattaaggagcatggcatgggaactgattaagtggtgtgggctgggttgcagagtgagaggggcttaggtgactctacattctctgaactgaactagtaagtagatgattgcacaggaacacacatagaggaaatgtgggggtagaaatagctcagtttcagatatgttgaatttgaggtcatgttatttaatagacaccgttagattaagaagacagaaaatcagagatgtgcagccctgctatttccaagggaaataatgtgtggtgagatgcatatgtttgttaaatgttgtatgttcattaataaaaattaaaagctcaaaactacaaaattgtactgtaattaaccgttagattaagatgtatccttcctctagtaaaggaatatggttgtttttgataaaaattattttttgcttaagtcaataattgagtttccttgatcttggcattttaattattcttcttagtattttttttcccctcacttcattgcctcctgtttaggtttcagttgtgaaatgatcaggagtttcaagtgtaaagtacaatttcagaggtagcctcactagagaggccacattaacttccagatttattactagttgctgataaaatatgatttaactcctattggcctctcctgctgcctttataactgctacaattgtagtgatttttaaaatatggtcccagttgttccctaagtaagtctaatgtgttttactttccatacatcccacatatatattgaaattctttatgttaaaataatttgaagcatattgtgttttctttcaaacacttccagtcatcttattgctcaaatgccattctggttttttttttgtcctcgcagcatttacctttaagatcactgaagcaagtattaaatagcattagacatatcagtcccaaagtaaaacttacatttagatttgaattaatcttcaggtaccatttcataaaatattaccatatatatgcatttttcaaaaaaactttatatagagtgtatatatgatagatgctgtgctatatactggcacacagaaatacagcaaactaccatattaaagtaagttaccaactctactaattgtaattttattgaaacaatcttgtttttttggcttaatttgttcaaagccagttaattgttgtcgctgtgtgattctttagataattgcaaatgcatggaaaatttgctattatgtacttggctccaccacaagtcctgagaggctactcctaggaaaaatcatgttgaaggcaaaacaatttctttattttccccatattccttcttttgtgtatgccctaacatctctctctcgggaaatgttgttataattttatttacgtaagtatacaaatgatcagcaagacctaatgtgttgatttacattgatatttgcatccaataatagtactttcagtacttcaaaaacaaaaccatgtcctatggttttgtttaacatttttacaggatagttctttaggtacatattattttgactattttacacatgcagataaaaaagacaaatcactagagaaactaattttagttaagggatttgaggcatgtttcacaaaactattttgatgataaaataggcaactttttgtgtagtcagattttcagataggttaccttcaaagataacagccatgttgaaagtgacaaattatattagttaatacttgtgctttcacaatgtttgattaaaagcttttactgccaatgttctaatggctgagtccatggaatgagatgacctgaaacaggatcttttcattaataaagaaaaacgttgtatttattaattttcacaagggaaaatgggttttatcttctttgaaaaaataaggtagagcatggaccttcaatgacttagaacactaaagaaaaaataatttttaaaaaatattagtcatttaaaagccagggctgtgccatgctgtacaatatggtaacaacaatcacaggtggctagtgagcacttgaaaggtggctgatctgaaatgatatgttgtgtaagtataaaatgcatactgaagtttgaagacttatggaagaaaaagctgtataacatctcaatattgattgatacctaatattgattaatattttggatgactgggttaaagaaaatatattattaggattaatgtcagatatttcttattactccccttaaagtagttattagaaaatttaaagttccatatgaggctcatgttatatttcttttggacagcactgaacctagggttgacattttcaaagaagctgagcattcataaattagtgtgatcttttattctcagcatttaaagcaaacacatttcacaacagtagaaaagttaagataataattttggacctcggagaagtccagctttctaaattaattgttcattttaatggccctttggtgctaatccatcattctcccatatctaactcttttggagaccttaaagtgtaagaagatttaccatggacttgagtctttcaggattagaatatgtgtggttggttgagagaggataagaggacatcctgggaataggtatcagcatttacaaaggaacaaaagagcattgcattttaggtgaccagtgttaggatttgtgatttcaaacatgtgaagtgaataaagtagaatgaataaagagggaagaaaacacttatttgaaagtggattgaagatacacattttaaattaatgttattttttgtttatactataaaatcatatgtgcataaaattgacatttattaaaagctcatttttttaataaactactgagattttattatgtgctaggcagtcttctatggagggacaaagaagtctttgagcaaaaaagacaaagcttccttcccttatgtagcttacattctgttgggggataccaacaataaacaaacaagaaaataaaatatgtatataaaagaaagtaaaatgctatgaagaaacatactatcttggagggagactgcaatttaaaacatagttgtgagtaatcacctcatgataaagtggcgtatgatcaaagactgaaggaagtgagatagacttatggttatctgggtggtgaggggaaggcctggtgaagggggtgggcctgaactgatccaggaaccagttcttagaatatattttgtgagcagatatttcattaattacttgcaacctgctcatgctcgttccatatagctttattttctcttttattgtgaataatacgcatattgttttgtttggttttgtttttaacagtataatgtttccagagcaaactgcaataagattattatgctattcacggatggaggagaagagagagcccaggagatatttaacaaatacaataaagataaaaaagtgagtgtaattttataatatttaaattttaataatgatctaggtggtttttaaagagatagtgggtagtggtagtgaggggagaatttttgatttaaaacctgattgtgccaattataaagccatatgaatcatagattataaactaataggtgtattagagagctgttaagtataatatttatatcatattcacaagcaactcatgcctaatatgttaataaagtatatgtatgggtcctattttattcttatgcatagattgtaaataaaatgttattaaaatagagaaatcaaaggaatggtaaaataggaaaaattttaaactttaaggtttattggataaaatttattatattatttaattattaaagattgcagtaatactcaaatttcctaaatactcaaaaaatgtctaagtattgttttgtaaatttacaaaaaggcagtttacaacagcaaaaactacatcctcatttgaaaactgattcctttcaagaaaagatgaagacaaatccttttataggtataatgtattaaaagaaagcatttcataagcaaatgaagactgtgaagattagtgtttgtagttggaatatatttgaatgtatgttttactataagggaagagtattacagagagggacctcattgaacctgatactgtggaggaatatcagcttcaatcaaaactctaactactttttctagccgtcctattatcagcttatttcaattttctgaccaacactccacattttgtaagaatactgtgattctcaacctggtttcctaaaatgctaatgattcatttaaaaagtaatgagaaattataaactctttctggtgtttcaaaaatttctacaaaaatcatacatttatatataagaagactctgcagggtaaaatgcccattcactttgcttctgattggaattttcaccattttgaaaggtgtggttattgctagctctaatggattgttttatatgtgcttgaggaacacacatggattgggtgttgaaaagcgagacaaaaatgaatatgttcagatggtttggtgacaaaatattgtgaataatggcgaacagtttgatgaaaatttttggaaccctttaagatactctaggtgctaaaattttcggcctatgagtatttgaaaatgatcaaaagactgaaataatacacatataatttcaaattaattaaactctgcttactgcatgtactacagtgtcatacagtttaatgtaaggtttaagggtacatcttttggtttttgtttagcatctggtgattttaatagcatagaggaaccacttttgaaaagttgataaatgaactgagctgttaatagattgtgaatattttcaagtgataactagattctacgaatatttctttcaaagaaatcatcagaaatgaatgggaatatccagatgcattaactaatatgtgcatatctttatttaataactcttactccttaatcaaaattcagggtaatcctcaccacctggaagatgtccctgaacctccttgccactgtaggctcctttagatgcttggcctctgatcccatagcacactgtgcaaagccatatacatatccttcactctgtactctacccatggcatctctcctctgttcctctctggattaaaaaaaaaaaatctacagtattgggacagtgtcctgtttaactgtgaactttaggcatgcagcccagagcacagatccagtgatagttcctaatacatcacaacaaataaattgagaatacgtaacagaggttggaagcatgagtgctgttacaggacagatttataattataaaatataactgggggcaaggaatatgctgctttcacatattttaaataatctagcatttccttattttgaagaactcaaatataacaaaagtttaacacaaaattcaattctattaatataaaatgtactatctcaaaaatttacaaattaatcttactctgataattggaagggactttttagcatcttatatttgtcataattttaagtatactattttgtgatagaagtatataagtgcaagccactacttatatcattttaataggtactaagtgtaaataaatcatttttttcctttcattatgtaatcatccaaagcaaccactaggaatcttgttcacctctacatactttatttcaaaaatgaaaagtttttgactcaaagatggcaatgaattttacattctgtgttcaaatttgtgcatgagatatatccgattttaaaagagtataaaggttttttcaggtggatttaactaaaagtatataaataagaacaagttgctttcatgtaaattcagaaatgtggtgttttttgtttttttttttcctgtttcggaattctctatacatccaggattaacacatagtgtcttggaggcatatcattaatttgatctttttcttttttttaaacacacaaagttttatgttataaggaaagtaaatgtattccatccactattttcacaaattgttcagttggttgaattagtgaagaatttatgggtttaaagcttcttttctatgtatggatcctaaaaatgtccaatctaaatatcattatcttgaaatacagcttctcattccagtcaccttttacaggagctcaactttttaaacaaaggttgcatttcatgacaagataaaccacatgataaaaagattcatatcacatgtacttttataaaactaataaatcaagttatattcaacttcaacagtcctgctctttgtctgctaacatactgatgctgtgttttaaggacacacacatttttcctgaaaacatataacctttattaatgccaaggcaattgtgaaaattaagtagttaacattcagttgtggtgatgtttcatttaattttgtctctaacataaaaattaaaatattcttggaactgcatattatattgtttgtttttctaacttcagaggctataacaaagttctgtgatacacagtaatacatatataaaagcctgcatacatacatacatacatacatatatatatatccacacatatttatatctgtttcaaatggatatcccctccaggaacaaggaaccatgtatatagctttggcatgacctctcttacataaagtgatatgagcaaaagccaacagatggttgagaagtaaatgaggaatgaggaagtaggaatataaatataagctgtttttcttttttaaatcatggcaaatttgctaagaaataaaagagaagaataagacagttaactcagggtcaagttgtgcgcacacacacaggcatacctcaaagatgctgagggtttggttccagatcaccacaaccacaatagagtgaaaattgcaattaagtgagtcacacaagttttttgttttcccattgtgtataaaagttatgtttactatatactgtagtctcttaattgtgtgatagcactttgtctaaaaaaagtacataccttaattaaagaatactctattctttaattcacaaaatgtataacaaacactaacgatcatctaagacttcagcaagtctttgtatttttgctggtggagggtcttgccttaatgttgatggctgctgactgattaaagtggtggttgctgagggttggatggctatggcaatttcttaaaataggacaacaatgaagctggctgcattgactgactcttcctttcacaaaagatttctctgtagtatgcagtgctatttgatagcattttacccacacagaacttttaaaacttggagtcatttctctcaaaccctggcactgctttatcaaataagttcatctaatattctatatcctttgggtcacttgaagaatgttcacaacatctttaccaggagtagattccatctcaagaaaccactttctttgctcatccgtaagaagcaactcctcatttgttcaagttttatcatgagattgtagcaattcagcccatcttcagtgtccacttctagttctcttgctgtttccaccacatccacatctgctgttacatcctccactgaatgctagaacccctcaaagccatccacaagggttgaaatcaacttcttccaaattcccgataatgtcgatatttttgtcttttcccatgaatcacgaatgtttgtaatggtatatagaattgtggatctttctagaaggttttcagttgggttttcccagatcagtaagaggaatcacaatttatagcagctatagtcttaccaaatgtgtttcttaaataattaataagacttgaaagtcacaattagttcttgatccatgtgctacaaaatgcaagttgtgttagcaggcatgaaaacacattaatctccttgtaaatctccatcagagctcttgggcgactacctacattgtcagtgagcaataatttttttttaacatatgtttcaatagtgggctcaaaatattcagtaaaccatgctgtaaacagatgtgctgtcatccaggctttgttggttcatttgcagagcataagcagagtagatttagcataattcttaaggaccctgagatttttggaatggtaaaagagcactggcttccacttaaagtcaccaagtgcattagctactaagaagaaagtcagcctgtcctttgaagctttgaagcaggcaataacttctcctttttagctatgaaagtcctagataaaattgtcttcaaatacaaggctgttttctctacattgaaaatctgttgtttattatagtggccttcaccagtgatcttagctacatcttctggataacttgctgcagcttctacatcagcacttgctgcttcaccttgcacttttatgttatagagatgccttttttccttacacctcatgagccaacctctgccagcttcagggaccactgaatataacagtatgatatcactatattcactgtatcagatataatgatcactataacagatgtaataataatgaaaaagattaaactattctaagaattactaaactgtgacagagacatgaagttagcgtgtgctgttggaaaaatggcaacagtggacttacttgatacagggttgccacaaacctccaatctgtaaaaaatgcaacaaagaaccatgataaaatgagatatacctgtacacacatatgattatatgcatattattttacaatagaagaccttatacattattataggctaaagatgaatgaaaggatactcagacaaggaaagcttatagatacaaaactgagaaaggctaattgatagagatcttgaaaagaggagggattgagagagagatggaacacgtttctgaatttgacaagtaggtattaatttctggaaacattgctgtcccacatttcatatgcactgtgaagttaaatgacatcccacattttctaatgtgagaaggccatgttaaatgaataaaacgttcatcttggaatttgagatatttaggtacaggcatgcaatcacattacatcatggaaaattgagtacccatccccttaagcatttatcctttgcattacaaagaacccaattatacattttcattatttttaaatgtaccattattatttactatatccctcttgtgctgtcaagaactaggtctttttcattctatttttttgtacccattaatcatctccacctccctacaaacccccagcatacccttctcagcctctgataaccactattctcttctctatctcctgaagttcaattactttgatctttagatcccacaaataaatgaaaacaagtatttgcatgttctgtgtccactaataatgagtataaatgatagcagacaaccacctttaattcagttatacttttgagtatacctgtattttattaaaacaacagcatttgtgtagtaattgtttatgcccaggacatatgtgtatgtgtagagtgcttatatacataaaatagtgtacatatgtacattatatatttttcaccatcttcaaatatggcttcaaatgtgtgtggatgaattgaggaacatgttctaactttattgcctgctgtacacacacccaccctgtgtgagcgatctgcagcccacagatattaataacaaagataattgtttattgttatctaaagttgtgcatgcagtactaattccagagccacaaaattaatgttacataatacgtttatcaactcagcatttcactttccacagaaatactatctttcaaatggccaatgtgtaaaaatgaaattcgatagatttagtaaaatataaatgctcagtactcttaaaaattctatgtttgaatgcaactttttaaaaaaactttttttaaataagttcacatgtaactttaaaatatcaaaatgacaaacataaaggaagaaagaaaatacaaaagaaaaataagacagaaaataacaaaatgacattaataaattttgtcttatcaataataattttaaatgtaaatgaattaaactccccagtcaaaagacacagagtggctgaatggataaaaaacaaaaccacactatatgctgcctatcagaagttcactttagatttaaggacacacataggctaaaagtgaagggatgaaaaaagttattccatgcaaatgataaccaaaagaaagtatggatagctacatttatatcagacaaaacaggctttaagtaaaaaaaaaaaaaaaactgacacgagacaaagaaggatgttatataataaaagcatcaatccagcaataatatataacaaagatgtatgcacccaacatcagaacatctaaatatataaagcaaacatggacagcactgaaggggcaaataggcagcaatacaataatactagaaagcttgaatacctcactttcagtgatggatagaacagccagacagatgatcaatctggaaacagaggacttgaacaacactataaccaaatagacttaaacagatagagaacatttgacccaatagaaataatacacatttttctcaagtgcatatggaacattcttcaggatagatcatacgttaggtcacaacaaattcttaacaaattcagattgaaatcatacccagtctccttactgaccacagtggagtgaaactagaaattagtagcagaaataaatagtctccttttgcagatgacatgatctaaatatagaagacactaaaggacttcaaaaagctcattagaacaaataaacaaaattcagtaacattgcaggagacaacatcaacatttgaaaaatcagttgtgtttctatactctaacaactaactacctgaaaggaaaatgaggaaaacaatctcatttacaatagacccaaaaagaatactacagttaggaataaacttaacaaaggaggcgaacttaacaaaggagttttatatactgaaaactgtaacactgtgatgaaagaaattaaagaagacaccaatggaaagacatctcatgttaatggattggaagacttaatattgttaaaatttccatagtacccaaagtgatctacagtttcactgcaacctccatcaaaatcccaatggcatttttaataaaaatagaaaaaaattctaaaatacatataaaactacaaaagaccacaaaatagccaaagaaatcttgaacaaaacaagactaaagctggaggcatcacacctcctaatatcaaaatgtattacaaagcttctggtaatcaaaacagtagggcactagcataaagacagacatttagacctttggaacagaatagagatcccagaaataactccatggatatatggccaattgatcctctataagggtgcaaacaatacataatggtttccccattgtgcaacaaatggtgttggaaaactgaatattgacatgcaaataaagatgaaattggatccttatctgacaccatacacaaagaacaactcaaaatggattaaaatctaaaatttaagacctaaaatgttaaaactcctgaaagagaacagggagaaagcttcatggcattcatttattttggtaatgatttcatggatacagcactaaaaacataggtaataaatccaaaaataagtgagactacatcaagctaaaactcttgtccacagaaaaggaaacaatcaacagagctataaagacaacttttggaattgggaaaatatttacaagccatatatttgataaggggttagtatacaaaatatgaaaataactcctacaactcaagagcaaaacatctctaataacccaattgaaaaatgagctaagtacttgatgtttttggagaaaagacatagaggtagccaatagctacatgaaaaaatgtacattactggtcatcagggaaatataaatcaaaaccaaaatgagatatcatctcttacctgtcaggattgctgtcatcaaagaaacaaaagacaagtgttggggaggatgtggagaaggtggaatccttgcacaatgttgatgagaaggcaaaattgtgcagcacccacggaaaataatatggaggtccctcaaagaattaaaaatataactaccatagcatccagaaagcctacttctggatacttatccaaaaaaaaaactgaagttaggatcttgaagagtacttctatattcattacagcactattcaaaatagcctagatgtggaaacaaccttaatgttccttgacagatgaatagataaagaaaatgtggtatatacatacaatgcaatgctactcagcataaataaaaggaaattctcaatatgtgcaaacctggatgaaccttgaagacattgtaccaagtgaaataaaccaatcaaaaaatattgcatgattccacttacatgagatatcaaaaatggtcaatttcatagattcgaagagtgaaatagtggttgcctgaagtggggagaagggagaaatggggagttactaatcagtggacataaagtttcagttaagcaagatgaataagctccagagatctgctgtaaacattgtacttagaatcagccgtaatacattgtacatttaaatgtgtgttaggatggtagatctcaccataggatggtagttcttaccataatgtaataaaatttagaaatacagaaaaattacaacatcttgaaagaaagtttggtgagcttaaaaaaaaaaacctaactctttgttttcccccaagcctcttgtttaatactaatgtggctgcagaatgcttcatttacattcatatttcatctagatgaatcagaaatctttcagagcaatccaggtaggcctgatgagttacaattggagagctgatgaatgaggctgcaggagatacacagcacaatttaatgaggccaaaaggtttgagaattagaacaaaatgtttgagttcttttgtgaaatgtgctactcttgggaattaatctacctgattatagataggtatagctttaaaacaggatccatgttaatctcctcacacagctgttccaaattaaaatacatttgctttataatctttacctgcagcattgccattccttagggctcacccatgtacatgagacctccttaaaaatagtgccaaaactaaaatgaactctatcccgtagtccaaacaaatgaataaaggaaagtaaaaccagacacagagttgaaagataatttccagggctagcaaaattattttattttccatagaatagccaagggactgcttagcaatacatacttaagattgcctagccagtaaggaaatagttctctgattctttaattctcagaattaatttaaaaaatgaaaaaacattcaaattaataaaaatttcaaaataactagtaaattgaatgagaacaaatgagaaaaaagcatatgatatgaaataactttcaaaataaagaatgcacatctaaagttataatcacttgacaataaatccatttttgagaatgcattattcttaacgtacttattttaaagaattcactttaaaaaatgattgagaaagtcttttctattttgctctcagatccaaactagaaatggtcaatagtttgtaaaatctaaaccaagttacaaatatctgaatatgcagatgtgttttatgtagttagagtgaacattgtcagtttttcaacagatagtaaggaaaataatccatggaaaataatttattgcatatctaatgtctctgcttggcttcttcatgcaaaagtaaagcctttggaggaaatgttcaaatatatgataatgaaagacatttaacttgtagcatttaattctatttaacacatggattgcttctaaaaacttttgtttcagatattttgatgctttcaacagcttcttaaatttttagctttagaatagggctctacctttgttcataaaaaccaagtatttattctggagttactgtgaagctgaaaacaataactacaatgtaatatgcccagctagtagagcgatcatcaatttaaaagataagttttatgcacgtgtgtgtgtgtgtgtgtgtgtgtgtgtgttcttgtctctgataacatttatttacacttgtttctcatagagtaaaattagtgttgtcagtccctcaaactaaggaatattttaccaggcacatcttcagctttgaataatatgactttaatgcattttacaaagtccttttaatatctaaaacaaactgaatgaaaaatgaggttaagtattactttatgcacagagtatatgatatgatgtaaactttatagcacagaaatggcacttgaaattccaagtaaaatttactacctagaattgagattgcccattgtttgtgttaaaatgttatgccagaaaggcactttttgctggtttttctgctgctctcttctctgattaagaactctgctcacagtatatcttatcagagggattttcccccagtcaacctttctacagttgtctctttccccagacatcccctttatcattctctatttcagcaccctctttcttcctggtcttctttccctcagattaccattttttaattattttaatgctttctttgctttttatctggagccttcctctctaatataaactccacgaagtagttgtatacatttgtaaacataccaatgaattaattcttaaaggatggcacagtacttgatgcatggtaggtgctcattactagcagatatgttggtcatatcagtacataggcaataaatatgctcctaatctatacaaaattcataaatgttagaaaaattaaatagctttgttcttttagaaggaaatcattaaaaacaacattattttcctaaatttggaatgtggaataaaactgttatagatgttcttatatatgtcatcttataagtagggaacacttccgtttatataaaaaatgtagtgatggcacctttcccttcactctaatcagtctaacacatagtttttcatgagcattctcattatcagtgtcagtgaagtatttgacatttcccaagagaaacatctgaaataaatcaccatacagcttatattctgacctctcagctgataatactctttgcagaactgcaagttgcttggaaattcagtgggcccgtagcttattcttcctttatctagtactaaatgcatatagagaaaaaggaaacttcagattacttccttataatctgatgttattaggatgattcattatagttgctagtgaattaaaaatatcatagtatgaaaatatgtcatacacccacaggtaagacacacaagagaaacactagcttggttctttgtgaatgtgtgtgcaaaacttacatgactactgcactttgttgccgtttataaaacagtttttctgttttatttacttgagcgaattcaacagacatcgattaaattcttctctccgtcagacactctagcacatatgttggtcatatctgtaaatttgcaataaatacaggaaatttcgtatagatatatcttatgtggacataatggcatttagaaaataccctttttcattagagtttgttgctaagtatgataaagctcaccaaatttgctcatctaggaaggtgttattttgagttattttaggttcctcttgaggcataaaaggctaaagacccactaatggaaaatattacatcatttaatactaatagtttgactataaaagacattgttgtcttcatcatcatcttcattaccatagctaatacttacagagcttacaatttccatatattaatgccttatatttacttttcacttacaactggaataatcatattatataataataatatcatcatcaccatcacccccattttggaaataagaaaagcaaaatcagaaaagtaaagtaacttgctgaaagtcatgtggctactaagtggcagagtcaagatggtaatctacagtctgaattccgtaacctcatgcagaatgcgcctgactggccatttgtctgtgtctttctctgagcagctctgtggctatgctaatcataatttgcccacccaggagcctgccttcaagtcagacagcaagacttccccacagggatctgctccttacagctttcataggctaaggtggatcaccaaaactttgcaggctgcaagtaactttcagatccttgggctttataaaataaagtgtgaaaggtgaatttggacacttttatttattacataatgctataaaactggagatataggctagtcaaatgctctggattctgatgtatttgtgaattatggaaaccacattagaattttaccctaaaatattccatccaatctagtattttcataggcttaatgccaaaaattttagtacacagagtagattaatataacctatttctgacttcatttttctaacatgattcgaaggctgaagtttttattttatttttattggctttcttcatagactaatttccattattctttggagatttgcctattgtaaattaaagttgaactctgggtaactgataattgttgaggtgacagtttccagtaactgggttctgctgggaaacaaattcctatggctttttaaaataggttgaccctgtggctttggaaaactcttaattgaagacaagtattttagttttcaaacaaaacaaaacaaaaacagattagcagaagtcagaactgtaggataaagttacaaatcagtgggatataaggaacaaatcagtaatacattgtaaatagccaaaactgctcttacttaaaagtcttctcaaatcaagtaggccagagctgtaataccaaatttaattattggaattataatgttcctttcagaagaaaaatagttttgaaacaactaaaagtaaaattatgtaagtttataactatgaaaaagccataggaatttaattttttttgttttttgttttttgttttgagacggagtctcactccatcaccaggctgaagtgcagtggtgtgatctcagttcactgcaatctccacctcccgggttcaagtaattctcctgcctcagcttcccaagtacctgggattacaggtgtgtgccaccatgcccagctaatttttgtatttttagtacagacggggtttcaccatgttggccaggatggtcttgatctcctgacctcatgatccacctgcctcagcctcccaaagtgctggaattacagacatgagccactgcacctgtccacgaatttaatttttaagttaattaccccatccaccccacccccaccccaccaagacagaatctcactcactgtgttgcccagacagagtgcagtggtgtgatctaggctcactgcaacctccacctcctgggttcaagcgattctcctgcctcagcaccctagggtagctgggattacaggcgtgagccaccatgctcagctaatttttgtatttttagtagagatgggggtctcactatgttgcccaggctggtcttgaactcctgagctcaagtgatccacccacctcagcctctcaaagtgctgggattataagcatgagccaccacacctggatttaagttcaattttattaagtctgctccccaaattactattgcttttacaattatataactatgtgtgaatccagaattataagaattttttttattttcaaggaataatatagtacataaataagtgtactaagtatattttgcctaaaaagttgtttacctccagtaaggatgtctgcttatttaatattaaataaaaagattaagaatgtatgatgatgtaagtatagtgaaacagcccaaattgcaaaatgcaagacactaatagcccagttttggtcctgctcttaccacatactgtaatgaacttactgatatgttggataacaccaaagtcttcttaccctctggtaagaagtagaaaccactcaagcatctattcacttgtttttaacaaacatttgttttcatttatgagtaagacactacaatagaagctaaattgtataatcttggaacttttaaagcccaatccaacgtttattcaatactagcttcccacagtatttctgttgaagacctgtactccagcattatgaaaaatatttgtcaaagccatctgttactgtatatgtcttgtgtgactctatgatgaaaatttcatagaagcaaacattttgaaagatgagcctacataaaatcatatatgttgagaaacaattagctacttttctaggaacattttactcacaacagaaaagttttcatgtgcatttgttatatgaacctagtgttgtgattataaatatactactaggcatgagtaaaggaattttttctccacaaaagtcgccttagcctggatgtagacctcctctaatgtaagtgatttgcttgagtgagagttaagatgaaatatttagcttgtgtgactactagttaagcattttgagttatttttgtatgtcattttgtttttatgtaagatcatgcaaatgtgcttaaaagaactgtacaaatacacatctttgagaaggtaatttaccttaagttttaaattgtacatatttcaaggaatcactttatttttctataactccaaaattaaggttaaacaagaactgtaagtttaaagaagtaaaaaaaaaacatctgaagaagcagggtatcaatcatctctgtggactttagcatctggaatttagttcattgactattccacatggtggcagtagcatagtatggaataggaggaatgaaaccatttacaattccaagtggaaagttgtgtacacaaaagttcttttaaatttaaccaatacattatttatatgcactatacaatatgtaatgtgaaagtttatgaaatcagtgaagttaaaattcttatgtaattagctaaaatgtacaaagaaaaaacaagttcaacaatggtatggcgctagggaatgaaatttttttatattgattttttactgtcaaagaatgtgtgtaaggcactacaatagatcctaagttttgaatgacttatattaaacttcttctcaactgaatatatatttataagatcattatagaaagctctaagataatctatataatccataaaatcattaaatacctatgtgcatatgtgtttgtatgtgtgtgtatatatacatacatatacgtaaaaccaagataaaataatcttgggtatattagattgcgtaaatattgtaatggtaaagcagttgtataaattataaagaaggttgcatttgcaattaggattttagtaaacacttggaataaaatttcaggaaaataatgtctttaaaaatctctacaacaaggcaaatgaaaattgagaaaaggggtacaaattatacattgatgacatgggaatgattcagttagttaatgcagcttacatttaagtagccaagaacctatgcaagaaaaagaacaaagaggtttacaaaagagtttggcgtgtttcaaaaattataattaaagctgacagaatgtgcactaccccagccctgatcccaaataccttaattttgacaacctctgaggggtccatgtaagcaaacacgtagaagttaagtgaaacttttatagcaaaataaataaagcaacaagctttttttttggggggggggggcgggcggctagtgtttatttggactatttgaatgataacatcagtcaaataatcatatgtgtggatctgagtgtagcctcgatgttattagaagtgcttgcctttctgagacatagatataagattcatatagtcttacttgtttatttttttactgaaaagtattttatgaaaaatgttttactagatgattgttgtggtaacaggaacttctaggcaaagccatgcttccgttgaaaatttgaggtatgggttcaaatgttagttatgagagagatcccccagtgcttcctggagcatctggactttttccctgacttgaattcatttgatgattgtttagggtatggcatttaaattgaattatcagttagggtggtcaacctgcttataaaaatatttccatttagaagctcaactctgtaagcagtaaccctacattgaaatttatagacagacccaaaaatgacctaactgatgaattaaagaaaatgaaaccattgcattttgattgggaattcctggagagaaagatagattgagagagagaaaaaaaccaacttctgtcattcacttagaaacaattatttattcttacagtttgaagtatttaaagcttggattatgttcaccatgtggcctcttacgtaaccagctaaggcaaacctggatgatgtaagagtggctcacctaaaaccttacaaatgaaatagcaacatccctgatgtacgttttgggggcagggattgttataatgtgatctgtgtggccaagaccagtgaaagaacagagaacagatgtgaaatctcttttgagatttgtactctgaaatcatgtgcaacagttaaaagatacaaaacaattagaaaatgtccattcaaatagtcagtcaacatgaattagggaaaagctcttaacatagttcaaactggaatttgaactcatggaaaagtgattttctgcatgtctatttttagaaatagctaaaatgttgagctgagagtatgggtttacttagattactaaattagtaaaaatcaatatatatgtaaaaataattttattaagtataggttgacctcatggaatttaccttttatactttcacactattatttaaattcaatgtctttcaataaataaattataaaaactctctattgattttaaaatatttgcatactttatagcatgttaggaacagtcaatattttgattatatttaaaaatcctaggagcttagaatatctatttatatgtgtcagccaacttttatagaaaataagtaatatactaacaacataattatatgtgtgcatcccaaatatttccatggtgaaaaccatcacaaagtttaattgtgttaagcaactttgaagtacaatgacctttctgaatactttttcattactacatacctatgaaatagggaaataagctttttttgcagtgactagctatgtagataacatatataaccaggtgagacaggtgaagtgaggttggacctcaaagatgtattttcttttttctttctttctttcttttttctttttttgaaatggagtttcgctcttgttgcccaagctggagtgcaatggcacaatttcagctcactgtaacctccgcctccctggttcaagcaattctgcctcagcttcccgagtagctgggattacaggcacccaccataaggcccggctaattttttgtatttttagtacaaacggggtttcaccatgttagccaggatggtctcgaactcctgacctcaggtgatctgcccgcctgggcctcccgaagtgctgggattacgagcgtgagccactgcgtctggccatgaaagatgtactttctatgaatgaaacattagtcatactcctgcctgaggattggaatatgcaacatgacactcaggtacaaatttaaatgtagcaactggagtctgtgtttacagtaggttatgtgattttcctctggtctctttctgaaggctttactggcctcagtttttcttgtcatatcattcaactggaaagcactcttttcaatagaaattttagctgttttattttgccattgaattaaattttattcagcctaatgaatacctatttttcaattcatccaggtacgtgtattcacgttttcagttggtcaacacaattatgacagaggacctattcagtggatggcctgtgaaaacaaaggtaacaaatctgttttcttctaataaattagaagaaaaactattttggtagttgttattaggtgtacttatttaaaataagctaaaattgtagctaacttttataggaatcagacaagagtaagattctgaacatgtttttatagagaaaacacataccaattttgacactggcattacattatatgaaaattctgatatctgattatatttccacattcataaaataatgtattacactgaattatactgaatgatatatatcagatataatcttaaatgaaaaattaggaatgaaacaatatctgaatttcataaagcttaaatatgagagtatgacatacatatttttttctctgagtggtttaattactgtttttgaaaaatattaccttatacattccaggataattcaaatatttgcagtgagctcatattttcactcagaaagaatgatgttactgagaaaaacatatgttaatttgagaaatgaactgtgataccatggcaacaaaaagaacttaaattttttctgaaagttatatttaggcaaagattttatataaatataataattatccatcatgcatctttaataatttatccaatgaaaaaatatttttaatgataccatgtttcctattccttcatagaagaatacctattttatagtaactaagaaatgtaatgaaatttttcacaaagcctgtgtgtttgttgtgaagattcattaaccatccttaattttgatatttcagtattagctcagttttgaagtgaaatatattgttttcaaaatactctttataaaatatttataaaataaaataattttgtggccctttattataaagtaacatttatgtataaaaacatatatgtatatttcaggttattattatgaaattccttccattggtgcaataagaatcaatactcaggtatgattatttaaaacttgtttaaattatttttttcaagtaaaagatatttttctggtttaaatatgctcaatatggagaaaattagcaagaatgaaaagatctataatattacacctatattaaaatactgagtatcttgttgatacattggttttatttcattaacattgcaagtgttttcaaataaccaaaactcaggttaataaaatgagtatattgttattttcagatgttacaaacatcatagaaaataaataaaatcaaattttctaaaaatacatttcatgtaatttgaacttgagtctactacaaataatttttaaaagtttcttcaaattgtaggtactgtgtataaaattaaacactaattatgctggacaaattttacagggacctagttggaacttaaatacctcccaaataacccctgtggatctatttatcaatctaaaataaagttacaacaaggagatgatttttctaacatcattcacttgaaaacatgcctgttaaataactttttgtagaatgtagtaattaagttaatttaaatatttattctttttaaataatcataaattactatgaaaattgctactcctttttaaacatagctgaagatctacaaaataaacgaagtcaaaatttagcataaataacatggcatttgtggacgtgaatactgaatacactgaatgttgaaatgaaacagcagctgcatttgagtctgatgtctagatttggcacagtatttcctttattttttgatgtgtttaaatgtagttttgaatttcagccaaacaatctgtgatatgaaagaaagtatgtggctgctgtatgattttaaatttgtgcaattccacgcagtaaatcacagagccttaaatagtttagattaacatgaaacaattcacagggaacgtatttcacttactggctgtaacacagaaaaacaatgctctgattgttactagaaaaaaactggggtagatatattgtataaataatgtaagtcaaatattgttcattcaaaataacgtagccataccacctatggagtacccaaaatagaaattaactgattatatattcagtgtcaataattttgattctatattcatttttaactctagaatattttttctctgtaatttttatttcaacacagcattcctagttttaaccacgactttttttttttttcccataaacaggaatatttggatgttttgggaagaccaatggttttagcaggagacaaagctaagcaagtccaatggacaaatgtgtacctggatgcattggtaagaggttgagctattcagtcaaagactgtcataacaaaagcacacagatgatttctacttctttctagatgatgtctctgttttccttttcattaaaccctccccaaaatttcttctatcacagacttctttcctagaatttatataatttacataaaaacatagactcgtatgtagtagaaaactacaaatgcaaagtgttagcttattgtctacttgatcccttcattgggaatgtagaatttccaacctggaatgttgaatacatgggcatttcaataagttttttaattgttaatgtaaaaaaaaagatgaaagtctttgtgaattagaatctatttttgcagagttagaacaataattttgaagaaagtatttttaaagtagaggagctagtagaagcatgtctagcctccacagctatagctggatctgctaaaactcaggagtacatgcgattagataggcaaaaactttaccttatactgaaatcatcacaaacttcttcatgtattaatataatcttttgtgctagattcaacctcatactttttatggaaatacgtcattgaggcgatcaaatctggtgtgaaataacaaacacatgttaaattgtccatcgcacaattgacattttagtaaagatatgtcattatatttaaaagcagtggttctcaacaagggggtctttttgcccctcacagttcatttggaaaaaatctgcatttttgattgtcatggcttgaggggaggggttgctactggcatctagagcaagcttgtccaacctgtggtccaggatggctttgaatgcagcccaacataaacttgtacactttcttaaaacattatgttattttttgcttttttaaaaatctcaactattgttagtattagtgtattttaggtgtggcccaagacaattcatcttctctcagtgtggcccagagaagccaaaagattggacacccctgagtggacagaggccaggcacgctgttaaacaatcctgtaatgcagaggaaaatgcctaccacacacaacaaagtattttccctccaaaaatgtcaatagggccaaagttgaaaatcttttaaatgtaatttttactttcctgacatgaaagttataaataataatcatcgcacttaagctttattcttatgtttagtcttaatgagaagaacttatgaataatttactaaaataatatatttggagagaatcaaaataataagacctgaaaataaatgctgattcagtaacccttttccctacttggagttcagtgatatgttcttactacttttccaaatgtaatgatgaacccatagggcaaaatgcagtccatttagaattacttatcatttggtttttagaaaataaacatatacaggaagttagaagaaaaataggcactattaacagcagccttgcacgctaaggaagataaaatgaagcttgcttacctcaagccctagcttaaaattactgtccagtgttccttttagacatcacatatttacttaaggtcacatagtgatccaaagctgtggtcaaaatgttgcacttttcaaatccatcacaggacagtgtatgataggaggagtcaataattatgccctgttgtgtttcctttgactggaagttcattagccagcatgtctgcattgctggtaaggttcttactgatagcacaaatgacattaggaggaaatgttggttctaaatgtgctgtgctataagctgaaactgaatgtaaaaaaaaaaaaaaaaggaacacgtgaatttgctattcattggacacatatagcgttatttttactgttttgaagatgataaagtgatcctcatatattcctagttatttgtttataatctctccacacagcagattaaaaatatatgttggtcaaaaataaacagttatattaaaaaggaaaaggtaaatatatttcaaaacgaaatataatggatataatgagaaaaagaattctgacttcaaaatgaagccaatattgggggcaaagtgggttgtggttaagaaaatggagacattttagctgatattagtgtaagatttttgcaattggtggtgaaaagtgaaaccataaaaatggggtatagcataaaagttggggaagcactgagtatatcaaaaaaatgataccttggtcatttttggtaataaggggagattaggacaatattgtggagagttcattttaattaggagacaaagtgaagctctttataaaaagagatatgacaagagttgggctctagaaaatatttttaaaattccagggtagagaaatcttgttttatttctctcttattttctagagacatgtgcagtactcaggagtagagtacaagtttttggtctgcttagtaaatgagaaaaaaattcaagttgggcccaaatgagttcattcataattatctttaatatgttagtaatctagtaactcactttaggctacattttaccatttttagaagcaaattatggtatgcagtataaatgcaaaagtaatgcaaaggaaatgattacatccatatctaccttgtcttaaaccatggtagcatttttaaaaccatgcatatagattatagctctaacagacacttcaccaaatccttactaaattatcttttggataccagttttacgaattaatctatagcctgactttattgaggtgggaggttttcattggaagcattaatttatataattaaggatgtttcattgtctaatgttcttggttaggactttataagcgccaacatgtgtctatcactgtatgagtctgttctcacactgctgtgaagaaatccccaagactgagtactttataaagaaaaaaggtttaattgactcacagttccatgtggctggggaggcctcaggaaacttaaaatcatggcggaaagcatctcttcgccaggcagcaggagagagaataagtgttgagcgaaggggaaagccacttaaaaaccatcagacctcgtgagaaattactcactatcacgagaataacatgggggaaaccgtaccatggttcaattacctctggatctctcccacaacacgtggggattatgggaactacaactgaagatgagatttgtgtgggaacacagccaaaccatatcaatcatcatgcacccaaatatgtatggttgtttccttagttttatttgctgcaaataatttggtattttggtcttctggaagcttctctattattgtctctcctccctaattcattcatattcccattgaatttgggcctcctatgtgcacaattatgaaccacaacctgataccacaacatttgctccctgatattaataaatatttttaatgttctagtgaataattattccaaatccaactttatgaactcggttctgattccagaactctgttctgagttcttgagatttggatttggaatcactattcgtgagaagattaataataatttctcatttagcaaattcaaaatttcaaacaataaaaattattttaaagagtgattttgttaaatgtagttttgacatgaaatggttaaaattataatggatatagatgtcagtaacaaaagcaaactctgacttgaaaatcagtttattttgactaatctgtatggattcatttaatgtattaaattatgtgctgattaataggatggcattagttctactatgttaaactcttcagactagacttttatatttgatgcttgcagttgtcttttcttcataattttacttgtcaaaaagtactgcttattttggggtctacttagaaaagtagtactgcttctgaagagcgtaacatttacttagaatatcccagatatgcagtatcaatagaatgtttcttttatttatcatgttattcaactgcacatttttcatttagcatgaagtctttggcttagggcataaaaaataaagaataaggctacaaaaagggaagctaaataatcacttaaaataatattttattatcactctgcttatggaggccctgatattaggtgaactatcactatgaaaaagggggaggacacagggttactgaaatgcatacaggctgttgactatttgtgtaagctgattatttttgaagttatcttagaggattattttaaatgttgcatgcttcagtaggtgcctagtaggtcctaattatttccaagatattttccttgatattttaaaaataaattttaatagatattcaaaatgagttactagtttttgtggctctttataaagtaactataaaatgcaatctcagatatcaaaggttagtgcactctgacaaagcttaaattgtaattttaatttgccctttctctctgaatctatttttaggaactgggacttgtcattactggaactcttccggtcttcaacataaccggccaatttgaaaataagacaaacttaaaggttaaaagttaattgataaaattaataataataaatgacaaactgtgacgttgaagctcaacatggataagatatttccataagaaaatacatgcagtgtaattgtcttgtgaggccagaggtcaaaggcaacagctgcctatgcgataaccacctgggaaaaaggaaatgcaggtcaaactctctgttgccctagagccaagattcaacttaactccacttaactatgacctgatgagaacacagagtcagactctgggagtaattatatgataaatggacagtaatattgtgtgcacattttaagaatccatctgagctattaatggagtttagaaagaaaaatccaaagaccaaaagcatggcgatgtttgtatcaggtgtacattggtatattaaatcattcctccccaactcccaaacaatagctttttaaaaattatcttgtaacttaaggatctgatttaaattaatatttctctttttttttctatttttaggatacaggaagaataatttcatagaatgcttaatttttatagcactggttttttgtcaatgcagtaaaatgcctatttaaaagttctaaaaattatttatcttgtacttattatttgttaaatgcttttgattttaaataggattgcattccaattttttagcttgattcagaaggaatttgagattttgaagttaagacttttttaatactagaaactgattttataatgtaggtgatatacttgatttgagtagatatttatttccagtttatggtttcatgacgtctgctgcacttaagcattgtttgatcagttattatatatctcagttgaactccttatgttaataaggtggccatagaaaacagttatttctctttgggggcctattaccattcttaactatctgcaggttctaaatattgtaactcataaaagagtaactctcactttctcatacgtgttcacagatctcactgtgaactaagagattgcttcagttgggaagtttttgctcagactaggattggttcatggaaaagagcatagttgttgatacaactttcttactctatctgtgcctacacaaggtttaaatgtttttgtaattactagattttataattttttgcttattattttataatttatataattccatttgaaacaacaattttggacccaaaattttaaaacaatttccatctttatgtcccatagaagattatgatagcagtttgccacaagcctcctctacttgcacctaaaactatgatgcctgttgcttggtatatagaagttattagcagtgactagaaatagtgttttgaggattttatcaccaatatggtcacatacttttaggatagttacatacacaggaactatctgcagcaaaaatccaatgtgttcttattctatattgtataatctttaagctggacattcttgtggtttcttaattatagtaaaccataaagtcaatctaaactcacatatatagacacacagctataagggctgaccgtacaatagcagtgaaaataaatattagaagaaaagggtacaagaagtgtcaaacatttttatttatcctttatatattttagcctcaattatctagattttctttgctaagttaaatgatgatgataaagttgtgggaaacaaagctgagaatccttgtaaattgacactgagagtgcttcaccctatatatacatttaaactaatgtggaatataaccataatgcaagcaaaagatgatcatatgataattgtgtaaaaatacgtaaatttttgacataaaatgccattttttgccctcttattatagaaccagctgattcttggtgtgatgggagtagatgtgtctttggaagatattaaaagactgacaccacgttttacagtaagatgaaatttgctcttttgataccctttctagtttagaactctgtactaacttagcttggcacttaggtaattctcaaaaattatgggcagttatcttagcaaaggaactaaatggttaaaagcatctctaaaataaaatgattccatgttatctttcaacatgctatacaatgtgtatttaatacattatgtatttaaaagaatatagatttctaattgtgactcaggcatatccaagcttttttttttttttcttttccagctgtgccccaatgggtattactttgcaatcgatcctaatggttatgttttattacatccaaatcttcagccaaaggtcagtatataatttgtttacagtgattagtgttttgtagaattaatgattaatgttcttaataggattgttgttttaaaatttaccgtataacactaaatatcaaagtacagtctctaatgcgtctctcttcttagatgacaaggaccacacatgatactatatgaaagtgtgaaagcagttttcattttctgttaccaatttagctgcaacatttttatctcaaagacagccattatcacccactgagcctcaatttcatgcatcccacttctgactttgattttaaggctgtaagataaaaaggatattgctccagacaggagtgtgaacctgataaatattagtaatgtttatttatgtccaggccacattttctattgcccttctcttctagtaattaactctgctttccatctcccagaatggttttccttttactttaggacaggcctgtaaacagatgtaagagattgtataagtaaaatccatgtgatgggcttcagaaatgggaagtatttattaatcagcaagttaatctgaaagagataaaatgccatcgatgaaccatattatcctaatttttatgcctattttctcaagatacaagatattttcacaaattaccttgtacaactcatttcactcttcatgaactgtttcacagggcattaatagcaaaatttatttagacgtcttataattgtaactttagaagcatccttttagttattgttatactttgaagataatgttgaagatcctttaaaccatgcagacttatgcatactactactttctcccgagtcatggatagttaatgttagtcatatattagaatatatcacaagtgtgtgaacatactcacacaaaaacttgtgttatttaaatatggttcaaatccataagagaactattgatattgaatgcaaaaatacattaaatgtaatatattaattatatattttaatacattaaataatattacattttataactaatgtctattttagtttatctgactttggaacgtatttccatatcaaattcatcacataattatctgtagcacgtgtagctgttgatcaccctagttatgtttaaatgtgttgttttaatataaatgttgcataagtactttttcatattattattaaactaccacagctctttaaaagcatatcctgttaaattcctcttaaaagagtaatttatgtttggctaatcatcctatgattttgctatagcttgaaaactttttatatcttaaatttttttataattttgaagtattattgtttgggctttgtatatccagtgtattttcaattaaattcccctaactaaagtaattcaaaaggaataaaagtgtaatgtgggctgggcgtggcggctcatgcctgtaatcccagcactttgggaggcccaggcgggcagatcacctgagggcaggagttggagaccagcctggccaacatggtgaaaccctgtctctactaaaaatacaaaattagccgggtgtggtggcacatgcctataatcccagctatttgggaggctgagtcagggagaatctcttgaacccgggaggcggaggttgcagtgagccgagaccacgccattgcactccagcctgggcaacaagagcgaaactccatctcaaaaaaaaaaaaaaaaagtaatgtgatgaagggtgtgaaggatctctacttttgtgattataaaccttaacccttacccaaaggaactaacatatatcatagacagaagaataagtacaataatgcatatatgatttatatatatatatctatatatctatatatataaatctaccatctaagggctgtaacaatttaggcagttttcatagtgaaagagaagtaataatttgaagtttttttccttttctacattcttctactaataaccagtatttatgtagaaaatattactatttgaatgacattaacctatatttggctcgtatttgaaataattcactaaaatttataatattacagagaaaacaaattctttagcaacttcattaaagcccaattgatatttttcttccatattataaattagctttgcatatctttatatttggattttattaaagcaaatattaatatgtaacagaaagacatttccaaaaatactatttcagaacaccatgaaaaagaaattattctgaacatcaatttattctttatttctgaaattcatgcttatgaattctcatcattaattcagtaaatattatgatttccatttatgattccatttagtggctaaaggagcacgctatacagattgatacaagacctcataaaaggatgatatagtataagataattgctttagaaatcaacaaatacaaaggaacatatggtaacagtatactaacaaaatcttaattattttatcagaaattcattaatacaagtgaagaaaaataatgctatatctatagcagccattattatttaacaaggtgaaagtctaatgttatgcaagtattcctctttttttttttgtagaagatgagtgttctttaaaagcccccagaatatcataaaatagctacggacttttcacatatttaattttttaaggattcataacattttctcagtgtgtacttttaccagcatgaccacattttgacgtatgttgaattatgtattctgctttattccaaaatggattttaactttcttccgttttgtgtcattgaagtagccaggttaggtctacttaattagatatctcattttgttcaattctaagaaatatgtattgtataggaaattgtgcataatctatgtttgagaagttaatatttaaaataaatctacactgttatggttacattctctattagtttcatagatataacatttggtatcacttcagaaaacaaaggcacaaatatgaaacgttaaaactttttaatatcgtacaattttcttggttcattcaggctgctataacaaaatactatagactgggtggcttataaacagaatttagtaactcacagttctgaagactgggaagttcaagatgaaggcttggacagattggtgttctgtaagggcttgcctccctctagacagccatcttctcactctaacctcacatggaggagaaggggtgagacgtgtctctctctagggcgtcttttacaagggcaccagtcccattcatgagggacccaccaaccaagacctaatcacctcccaaaagcctttggataccatcatctctggagatgaggatttcaacatatgaattgagggatggacattaaaaatatttatatttgggtcaattttttgagaaaattgttatttctctctctctctctctcttttttttttttttttttttttgtcaaatcaatggaaaagtaatctgggacaaacaaccatttttcccacttcccaaatacgtacttttctagaaaaagaaaaataatagtcatttttcttaaaaatgtaacagtttgtattcattgaagatatttttacattcttattttattgactcatgaactccatacctaccaaatattttgaattctatcatttagacctttttgcaatcaaggaaatatctgacgaaaattgattataggatagaacccgtacctatgttgacatgtactatgatgaattaccatttttctgttgcttcagcctattggtgtaggtataccaacaattaatttaagaaaaaggagacccaatatccaggtaactgtgaatgaaggtagccttaacagtgctttcaaatttgctaaatccaagttgggattaagcttctgttcttaaagcttataattaaagctgcctttcctgacatcaagcttccagagcatgaaatgagatgagcatcatttcttaataagctggagcaaaaatgttattaatgatggtagagggtgtgtattggctaaccaaagattgcaaagtcaattatggaatcaagttaataatcagagaaatcataacgagatggcttctaaaaataaatttgttattaaaattgtaaaattaatgtcaaattcatgtgatcctaacaatttgcttgtaaattgacttctacgtggaaataaaatacaattcctatatgacagtttccataagccacagattttaagccaaaatttctaaaaagtgtaattttgggttagaagttaaagaagtttcccttagctaattaaaaatgtaccaaagtgcaaataagtagtgaatttttattacctggtaaactcattgcgaaagcttttccttttggcaacaaaacttcagttatcacatgtatacaatatttctaaatgcacagtaaaactattaataatcaacataaaaggatacttcctatagcttagcaagagaatttcagaatttcaaagcatgttcaacattatttaagattgtgtaggtaagcctaccatttctttgaaaaagttggtgacattaaggccggccacggtggctcatgcctataatcccaacactttgggaggctgaggagggccgatcacaaggtcaggagtttgagaccagccaggccaacatagtgaaaccctgcctctacaaaaaaaaaaaaaaaaaaaaaaaaaaaaaaaaaaaaaaaagaaagaaaaattagttaggcatggtagtacatgcctgtagtcccagccactcaagaagctgaggcagaatcgcttggacccagtaggcagaggttgcagtgagccaagagtgtgccactgcctccaggctgggtgacagagcgagaccccgtctcaaaaacaaaatgagtaaataaataagttggtgacattaaaatgaagaggtaatatgttattaagagatggataagctgtgaattagtagaattgagtgctagtttggttctgaaagccaacactgtgttcttgagcactccactaaatcctgtagtgtttaattttcttcatctgaaaagcaggagaattgaactagtcactagtttccatcctacacagtatattcacctaggaaattaaatatatatatgtcagtcccctgcctcatcctctgaaaattctgatttaatttggcagtgatgggaccaggcctctacatagtttttgttttgttttgtttatttatttattttttttctgagatgggtctcactctgtcactaggctggagtgcagtggcgcaatctcggcttactgcaacctctccctcctgggttcatatgattctcctgcctcagcctcccgagtagctgggattacaggtgctggccaccatgcccatctaatttttgtatttttagtagagacggggtttcattatgttggccagcatggtcttgatctcctgacctcgtgatccacctgccttggcctcccaaagtgctgggattacaggtgtgagccactgtgcccggcctctaaatagtttttaaagctccccatggaggtctaaagtgcagagccactgccctagttgagaaactttagctctcttccagtgctagaattttagaacaaactgaatttcctattgttgcatatgaaagtcttcatatcttttataattcctataaagtttaaaattatgtttatgcctttcttgatatagtaaattgttttgttactgtccttgcatgtttctttttatgtattatcttatacttttgcagtcatgtgcattttagtgaatttttgtttttgcagcagcctcaaatattgcatgtaactcttaacaatataattaaaaaataaacaacctgaaaatggtctgttttatttttgttttcattctaagaaaactctaaatggcaaactagcaaccacacaagactcctcaatttgaaggctatttttgaactaagtagcatttgtaatactatctagtaattatttcaatttaaaatttgttaacatttcattctttcgtttccacaaatggtgtggtatttatttccattgataaccaaattttgcaaatgagaaatactaggtattttaatatcagacaaaaacaatgggtgtgcagagactatattccagttcttcagcctctcttggtgctttcttattgaaagattatgcttttgaattttgtagtcaccatgcccgtggtgaatcttttaaaaaatggtcagctagattgctatattaaaagtacaacttatgcattgagatttttcttttatgatttcattttcttctctgtgtctttgtatgctggattgggacatgatcttcatattgccaattcttcctgataatgcctcctccatgcatgctgtttgggtctggtcatgctatgcattatccattgcatgtaagataaatactcttatttctgtttactttttattattttcattattttgactttgctttgcagtgagtttgttaaaattttaatgctgatatgatggtgtttgtgtgaggacagtttatttcatgggacattaaatgagcaattctgaataatgttgtaaactttagagtatccttttgttaggggttttctaggtttcattttttaaacaaagaaattagaagaattttcaacattggcttttattttattcttttaaaatacgctgcatttcaaatgagtatttccttttcacgcagtaagatgtcatcagtatcttaccaatactggtcagcattttcacctttgaaaaatttaatacttattttcagtattctagaatcttctgattgtagtgatagagtacttaagcagtgaatatttttttcaattaaagtgccagacatggctattttttaaaatttgcctttaagaatgttcatttatcaaaaaccataggaatcaaaaattttcatctttaggtggaattactctttgaaggaaggcatttttgtcagtaaatacatgccgtgtatactatgtcattcaacatcttgataagatatgcttaattttagtacatttttacttattgcaactgccttgggaagtttcttcctaaaacagtgcttaaaatggtgataatttgaacatcttttgaaagagtctgtgaggcttatattattaaagtttgagtgacctttgcactaatccagcatagtttgcgtttgttactggaatctagttatcagatttaggtaatattttaataaaaattaaaaattcagtttctaaaattttgcaattatgaaattacatatacctattatgattttattggtctagtaagctttgaaattttagtatgacatgttacattacttaggaagttatagaggaattgactgtattttgtttatcaaatagttcaatgaatcttcattttgcaattgagacattaaaataatatcatatgaggtaaatttgccagactaacagtatcattttatataatgatatgaataaataagaatctatcttattccccagtgttctttctttattattatacaccagcaagaagaagcaataggaaatagtattcattgaacccaggggttattatcctagtaagactttaattataatagctaatcttaaaatctttatgacaaccacaaaatttatcttatacattctgatgtcatttgaattattaaaatataaaatttcttagattgaaatatatgaagcaaacttgcaccttttctttatatactttcagaaggaagaacaggtccaatagaatgttttacttggcaagtgtagacataattttaaaacattttctcatacacttttttttttttttacaaattttaaaagtatgcttacatgttgccattgttttattaccaaataagtcatccaaatggctatattttgcccctttcccatgctaattaatgaaaagaaagttgtgaatggttcttcaaaagtgatgtgcccaaagagcttgtgaatataaatgcagtatcaaatacagcactcaaaatgacactgtcttcacttgcttattaagatttcctgcacttaaagctcaatctctagcttttatatataagctatatatatatataaaatatatatgaaagaagatacctttatacaattattgtatcctaggtaatttttgcacaatttcataaatacccgttaaattgttttatacacagcatcattgtataatgttacatgtacctaattattattgttttctgtgtagaaccccaaatctcaggagccagtaacattggatttccttgatgcagagttagagaatgatattaaagtggaggtgagtggaatcagtaagactaaacaattcctcaggtcagatgctggtatgcactcattctacaagtatctgttgaacggctacaatgtgttagcttgtctgtttgatactgtatacacaaagatgaatgttctttgtcattaaaattttctagatcctaggttttcctatccaaaagatcatatgaaaaggaataaatgtttaagttgggttcgaccttagtcttctttctcttcctaaaggtagacatattttcactattctaatacaaatgtatcttgtaaacttcagtaaaaatcatagagatggaggatgttgttatagtgttgaaaaaaaagttggaaggaatccaaccacccaaacacataagaaatagcatgagtagaagctgtcatgtttgccttaatacattttacttggcaatctattttatttcaaaagcaaaattgcatatttcctcctctgagagagtcttccataataatgagagtattatattaataataaaaatattagaaatatataataaataacattatatgatatatgttagtcatggattctcaagaggcttggaaataggtatttttatttcaaattataatatctgttgtactgatgatacatttgaggtacagagaggtcaaatagtttctctacagttcttcagctaataagtagcagaacttggctcttgcattctagattacagatttttaggatttttccagatggattaactcccttgcaaatgccatcatgtttcttttataacttgtcactgcatttcaattgtagaacaatagaatttaatgatttattataattaccctagacggtggccttgtgttagggtgtttaggtgattaatagtatttgttgtaaagtaattgacataataaagtaggataaagtaatggggacaagcttggtgtctggactcttactccagtgagtgaccaaaatgatcttagattctgcaagcctcagtttcttctaaatcaatcagtaatagtgattgaatgaaataatatatagaaaggacttagcaaaaggcctggttcatggtaaagtctttattatttttgagctcctcataagtgcacactcaacttacattagaagctgttatctactccttcctttaagacccaaatatttgaactaaattagatacatcaaacattcgtgttcttcaaattcaaattattcctttaatcacaccaagtttgtttacttatcatttgcagcttcccgaagccacatgtaaatcactggttgagttataaaaaataagttgaggaaacttctgagaattgccagtcgactggaatatttagtggataatgtaaccttgcacttttttttttttttttttttgaggtggagtctcgctctgtcgcccaggctggagtgcagtggcgcaatctcagctcactgcaacctccacctcctgggttcatgccattctcctgcctcagcttcccaagtagctgggattacaggcgcctgccaccatgcctggctaatttttgcatttgtagtagaaatggggtttcatcattctggctgggctgatctcgaactctcaacctcaggcaatttgtccgcctcggcctcccaaagtgctggaattacaggcatgagccactgcacctggccgaccttgcatatttttaaggatttggagtattctactgaaggagactcaactctattattctaaatccaaataggtgtttatagttttctctgtcctttatttagatttttttggtacccagatataagaattacaaactaaaaagtgtaaagagtcctcttaaaaatatttttctcacatgaaactcattgtgtaaggcagaaatttgaagcattccgtgttatatgtaattctgtacatatacatttctatgtctcaatgactactttccactccaatgtggctagccataatataattgaacattttattaattacgtttcaaaaactaccaacaggttgaaaatatttcattaagggtgttttattattttaaaataatgtaaaatgactataatatggtaacttaaaaaaattccctgagaacaactgcagatactggtaaaactaaccccctatttttattttatttgttctaaataaggtaaagaacttgaaaaactaccatgttaatagtcatattttggcaggtcagctttgtttctggaataaagtagttgtttcatttactcttagattcgaaataagatgattgatggggaaagtggagaaaaaacattcagaactctggttaaatctcaagatgaggtaagaattgattctagcttattcttaaataaaaattatatcaagaataattgatattggtaacttgtcctttttttctattaatccactatttacttataaaacagggagatctctaggaaacaatttttctttttaaagcacttcttagctggagggatattttcactaagatatatttttaaccctctttttctttttataaaatactattgctttaggtttcttgatgttttcttatacattaacagtatattcttgaaattatattttacatacatattttatgagaaatagaatacacaatataatgttgccatgttgttttacactatgccaatgttacaaaattgaagttaatatttaatagctatatgttttacatgatttgcctttttattctaattattgagttccacatattaattatttttatttttagctttttgtttacttgtttctggcttgatttatcttcttttactagttacacactttaaaatttcccagcacttagatctgaaattaaatcctgtgacaacacaactacccccacaaataattggtttatgtctattatcatattggagtatatctattatcagtcagaggattatgtctattagtcagatgtggagtacatacagacatttatacatttgagtatttgaaaaatgtaagtctcagaagcttttgagcctggaaattttaacttaagcttttatgtataacctatatccttttcctcacaatctcatcatttctagatgaattacattcctctgaaattcctcatcagatccttccctaggtggaaggtgagctaggatctgactatgatccttcattagcacatggcctttctcattttaatatcataatgagtccctattacagaacgcaaagggaggtatatttacctttcagtctttgttgaaacttcaactctatttgcttagacttttgcacattcttttctcagattacaaagtaatattctattaactcccattgatatttttcttccttcaatttattgcaaattactttttttgacaaatattcacctaaagactatattttcctgtcttagaattttaaaatgtctctgatgaacacactattgtaaatagatataactgctaattttcaattactacattgccttgtactccagatttctatgtatattggtatttcaagaaaagttatttattctatgaatgactataatttttatcactattcactattttatagacaattacaacactgtgcatacgtattattctaattttaaggtgatatctttcaaaagctctatctatatggtctatgtaaggggtttggcagagatatttaagatgtgatagtaaccttcacattatagtgttatttggtttagccaaagtagctgaattccacaggcttaggttagctattaactttgaagttcatttttgtggttgttgtaggaattatagaacctttcttgtaccatgttccatattgatgagctaggaatctccagtttggcacatttcacaatgtttggcataatgagttgcaagtaatttgaaattcctcacctaggaaatgtttcccacagaacctctatttacacctgatttattgaatatttttcactacaatctgtctgaaattaatttgtaaacatttttttcatggtcatgtctttcatgagtcttactattctataaaaattgtaagtgtatagaataaatgagaaattatatgaatcaaatttttaatgcacatatgctaacccttatgatactgcatttttatggattttagtattactactgaaataagtttaaaatagaattagaacttttcaacttaatttatgcccaagtgaatctggtttgttggaatctgaaaatagtttgtatttattatgcatactccatcaacagtcctttgtttataactatatgcttgggctaaaactagaattcatttgtactatttcatgcagaaaatttactgaaagatggtagaatttagtaaggataaacttactgaataatgacttttttaagaagctaatctgagaatactttcaaacttcaaaagcagttgaaaaatagatttcttgactaaaaaattagtaataatgtttaaaattgtccgtttgattattttattacaaattgaagactgaacaagattataatttctgctactgatattgaaaaaacttacatttttatttctctgctctgatactgttttctgatactgtattttatttataacttgcagaccaacacttgcttgccctgtttttttatgagtagtaacaaatatataagcattgtttcttctaattcttttaagaatattgctagtccaaagccctcttcacaaccctgttcccccctccatctgccacacatacaccccacacatgctcacacacaaacacgcacacattcattgtgtagttgtcacaaacatgaatttggcattatatattttgccaacttaagcaccttacctcttctttaacacttatttcttcatcaataaattgcaggatataaaagtatatactccagtggttggactaagtgacagaatgacaggtgcttagcatagtgcctgataccaagaaatacttcaatacatgttactgttttggtgagaatgatgaaactcaaaaataactaagcaaattaaaaattatacatgtgccagcggctgagagcggtggctcactcctgtaatcctagcactttgggaggccgaggcgggtggatcacgaggtcaggagatcgagaccgtcctggctaacacagtgaaaccccgtctctactaaaaatacaaaaaaaaaaaaaaatgagccaggcgtggtggcaggcccctgtagtcccagctactgggaaggctgaagcaggagaatagcatgaacccgggaggcggagcttgcagtgagccgagatcacaccgctgcactccagcctgggtgacagagcgatactccgtctaaaaaaaaaaaaaaattatacatgtgccatcgcaatacctaatggaagacagaatgtataaaagatagagccatgcatgaacttccttagctctgtattttctttccctggtgggtttattagatgttgtcctaaccttcagtgatactgagtagcctcttatgataccataataatgctataatagtggcttcataaaaacagtcatatgctaatcataaatttggatctagacacactgcattaatgtcctgatgttgcctattactcttaacatactttagtatggacatatccgagccttgtctaaatacttcatagtcctgtttcattattaaaatttgtttttcaggaaatactgttttcaatgttttgaagataataatttggcataaactataaagatttttcacttacatttgtttctgtcaaaaattttgctagacacacccagaaaataaataaatatagaataaaatagatcatacctttgtaaagatgagtattaaatgactacaaaatttataagtaaattctacggctttacttttcgtatatattcatacaaaatgtaaagtgataataaccacgttaaacttctttctagagatatattgacaaaggaaacaggacatacacatggacacctgtcaatggcacagattacaggtaattaactgtattttatgtgtattgtgtattccaatggattaatattaagtctgcattttcacaagtgaattttcatgtgattttcactagaaaagttcccaacatgaaaacatactaaacttatagactaatttttaaaatggaaaagatggaaaaactctagtaatataaaatttagaaatgaaaacctatgtgatataaatatatatattttgtatttttacatgagaaatgttgacaaatacccataataatatgtagggttcactttcactgacttcctcttttagttgttgtttagtttacattaggtacatttgagttgaaaactaactaaaatataaagcttatctcatcattgtggtatctgatataacatgtttagttgatataatttacctccatgagtatcagttctataatattgtgattcctcccattggctgggcttcggaaagttggacagcctaaaacctagtaatctcttggtaattctccattcttcaacacttgctcaacacttccttcactttcttgctctaactctcctctgagctcactgcttcctctgaagtctttagaatactgagggtgatatgagtgtgtcgtcattactcattctgttttttttttcctttctgaaattcccatcttttaatctcatgacaccaaaccacaccacctgctattcctccttcttaacagtcacatccctctcattcctataaagatttcaactcctggctcattgtcactctctcctacattcacatagttcactgttttgcaaatgatgccatacccacactggtgtaaagaaaaataaaaattatttaataaaataaactttaaaagaaaaaacataagctcaaaatttttactattatatttcacagacataaaattagtctgttacattgctataaaattttctaaatacttctcccaatttctgtattttgctatcacgggcttgtaatagacagtttgcaaattggctaggtccatggaaaacactttaagtagcattgacatagatgatgtttctaatacctgggctctgttacttttggccttctctcctctaatgatcttgtcacccccctaccttagtcactgactccaaaatcatattctgcagctcttacagtgtcaagtctgcaatgccttcatagtctttacatgagaatttttcatccaactctcaggttaccacattttagctttccatcttctcctgctagtagcccaactgcagtaatccttgactcaagacatgaaatccatcaatcccttctccctttttgctgtcttgccctctttgtgtccttgtgcccttctttatttagcagaaattccttgggtctttcactgtcttgtgcacaccaccaactcctttcatcatagttgaatttggcatacagcaatttggcaaaataccagtcctggttaaattcaaattattagccacaccacactgcacccatacagctaaaagtgactgaagtaaaatgctcactagctgacatatcacctaaaattcatgacctctaacctcaagtgggccttagcggtagctggcagtatccataatcctgtaattttaggactctcgtagatgactcttgatcacttcactctccaaacctgtaatactgtctcatcattttcgctcaggtgatgaatttgctttccatttcacggagaaaaatagaagtggtcagaaagaactcccactattagagtacataactacttgcatctgtatctccatcgtctatcgttatttctgttctcaacacaatcacaagaaggatcttaacccttgagtagactgtttcatttctctactcaactcccaccagtaaatttgctacctcattcagtctgacacccgaagtctggcacggccatcagtggcgtaaatcatttgaccttactgaccgtcagctctgtgaatttatcttccagattctccactgaaaagtccctggttaagccacgctgtcctttttgccacacaacataaacactggcacccatctgcctcagaacttttgtatatgaaattacttctgcctggaattacttttcccaaacagtcacatgctcattccctcatcttcccatctttacttacttttcatctcttcagaaaggccttctccaacgatcctatttaaaatgtataatgtttcaccacactctatctccctcttccacttcatattctccataacccttattgaaatttaacatcatgcacacacacgaaacatatatagagaaacttatttctactgattatcatctgttctctcactagtaagttccaagagggcagggattgttccctgctttatttacttctgaatcatcagcttgtatgacagtggcacatagttggcactctacaaatattcacagaattgaagaatttcaatttggagaaatggaagaattttccaactgaagaaattttcaatctgtctcatcctttcaaattcatatagtggtgtacagaacttccattgcaatatttaagtacggaagtctctttaactacatattaatatacagttaatatgtaggctgtggtgaactcaactatttctctcctaataaaaatcaaaccaactccccagaacatacacataagcttttatgggagcctatgttattatcataggaacttatctcctttagtattcctaggattgcatgtagaatagacagaagaggagagcatattgcaaaacaccagaatggctgttttaattattttacttttttctatcaactgattcctatctctaatttctaggcatttctttatacatgcacaatctttatgtgtatacacaagttactctttttcctccctcttccttattgccacctttcaatttttggattaacttgtcaaaaggtgcaaaaagagaggaaatcttgaaggtctgtctcttgagagatgattttatgataaaacaaagtatcagggcatcgtatgagaatgcattctgtgtctttgttgcttagatgaacaaattctgagaaaaactgggttcttttgacccttacaatgtgatagttggctctcctacagttataaggacacttttggggtgttttacgtgtctcacaaatggcctctatgctcaacctcttttccgcatgcacccagtgataatacacagtgtgagcaggcgaatgttcttttctcgagttcatgtcactctttgttgacaaaacttttgtctccttccattttcatcatcaagtttaatttgaacttccaagtctgatagtcccttcacacatttctaacccaatgtatctgtcctgtcatttctgccacttccatcaccatacatatcactgttctctgacaaggccccaactttcccacctttgcgtttcctcacacattcgctttccaagtctccaactttgggccagattaaatctatttccattggaaatacttttctgaatcactgtacaaattcacaaagagcaatttagaacaaaatgttacatctaagttgaaggaaaaaacatgatatgttttgatttcatgaatgagatacaaaattttcatctggtgatttctctcttcttaagtcttgatccaagtaccatattttgaaatgtaataaattattttaataggatgctttctctttttttagagaataatttacttttatggagataaatgagttgaaaagtgtgttatagtccacttaactcagttaaccatgtttctgtcagtcacaaaacactgcctgggctatactattcatctggtggccacttgctttattaaactttaatctctagaaggaaataaagcagtcttggtctatcagttttatatggacagagacagcaaacattgtatatgacagcaccattgactaggaatgttgataaagatcttatctgactatatgttgaaaaattaacttggcttgagatggacataattaaattaagtatagctatgtttttctatagaacggactgtagctattaataacaatcaaagacttacaggccaacaaaacgcatagtagatgtgctagttttaaaacttctcttttcttcctcatgggtttccatactatatttatggtatattagatgtaacccaagcttatccagtgacactttagcagttgtatgatataatgttatcggttttaattagaagtttctcttagcaataaatgctgatggggcaataaaaatgtcctaatttcccttgagaagaatttctgggagacaatcttcagtgctcagtaattctgctgtacattttgtaaatggcaagtgaatcatgaaaggtcatcttgctgtcagagtgattgcactgcttattttaattttaatctctgcctccacttaaaggaagttacctataaaatgaatatagaaattttcattaagtctacataacattttatttccctgaccttttcccataaggaaagtctatgaattacttaataatagagaaagatttgggaattggaggtaacaagcatccattcattttgctatctttattgtataattaaattttagcaaataaacccttgctttttttttccttttcatagagtgaaattttaatatttatagtcatatgaaattttgaaattttatgtttttccctattctatattgtccataaaaatatataatgatgttaggatatccagtcccaaaactggggctacgtgaggcttaagtgattcagaagatctacaaatccctaaatctaaaagttgaaattattaaaaattaattaattaattaaaggatctacacatgcctggaaatactcaaaagcatagatatacacaccttttcctgcacattactaaaatttgagctagctattaaaagtggatgctgaaggtgaccaagtgggttacattaaacaagtattacttttggaaagtagttagattgggcattttagaggtaaacccactgttcacaagttttcttctatattcaaagcatagcaaagatcatgtggctccatagcacatgtggatatggaaaagttatgtcctacatttgagtattagcatgagaataggagaattacacatatgcagttgtgttattggaaagtgcataaaattctgaaatcctttaacaattctgatgtgttttattattttattttattaattggcaatttcaaaataagtaagattacctgcctaacagctttttattttgggcagtcattaaggcaagttttgatggccagcttgtctgacattttttgtgtctaaaacattctgaatttggcctaagattttcactggaaccctcctctgctttggacatctaccgtaagactagagtagcgccgtggctcttgttaactacaaaactcaagacacatttcctattacatctaataacaatcttccaaataatgtggaataatcacagtaaataaacttgaaataaatactatgacttagttttactattgggtataaactaatgagcttagcaaacaatttctgttagtgcagtaaaggaatctgaatttgcctatgagtagactagtactagagaacttgcccaaggattagagttttaaaatagtggttatttaatccctcaaaagaatatattttagatgactttatgcattgttcaatagtaatgataatggccaggcgtggaggctcatgcctgtaacaccagcactttgggagtctgaggcaggcagactgcctgggcaacatagtgtaaaccctgtctctactaaaatacaaacattagctgggcgtggtggcatgtgcctatggtcccagctacttcgggggctgaggtgggaggatcgattgagcccaggggatttaggctgtgatgagccatgatcgaaaccactgcactccagcctgggggatagagtgagaccttgtctccaaaaaaaaaaaaaaaaaaaaagtaatgataatagtaactcttccatttgtattttaatagtgtccattttatacaaagcactttaacattatatataatacgttaaggaagtgtgtccaaatggtattatgtatttaccttgtttaaacatacccctaatgttcttcaattttttgttaaaattcaaagtaatttaatataattttctggaaacatagtagggggccatgacactccttccttggctaatttatgggttcattcaggaacttattttccacttgtctcttctgattccctacaatgtagagagctagatgactctggatggcaagactgaaattaagtactgtatttgctgaatgcattttcttgtcaaagtaatatgtcttttccttcccatgaggaagatctttcgattttcccatgaacttgatgtgtcttttttttaagttatgtttcatttttgtttgtttgtgtttatgcttctcttgtttctattgcagtttggccttggtattaccaacctacagtttttactatataaaagccaaactagaagagacaataactcaggccagatgtaagtactgtgaaagtgacttcagggtccatttgttatctcctagtatcagatgtttaaatacgtctagattttggaatacccaaggcttatgaaatattttagtaggtgttattaccaaatctacagcaatgattctaacccattccaaacatgcaaggaacaagaaatattctacatggatagaatatgagcaggtactccagtctcactggcagtccccaccacccttccctgccttgctatgtgctcatagaatcattgcagtgctgtgtcctgttgctgtcgttttaagggtctgctagctggagcaaaatgtttcacatgctacttatcaacatagtctctactctcatggcactgtgctagtaaagcttttccttttctttccttttatttgtttctggttatttatttatttattttgcatttggccagaataatattgtgcttcacatcttcttctactttgaataaattaaattgcactggtctttggctttggtttggcaattaactttcttttcgtaatccaaattaatgtctcagtaatgcaaatggattaatttttttaagcctcatttggaatgtagagtaattaatactagtgcatacttcaagttattgtttattttgttttgggtgactagattttgtaaagtaaaatgaccatcatatcctttgcacactgccgattattgctaacaaccttaaatttttctgtgaggatgaagtaaaatacaaaagaataccaaaaatatacgtatatattttacatctgatcttaaagtaagctacagtttctttcatttctctgtcagttcttttttgcccgcatcaggcctggtgttcactgtgcattatacatagtacatttatatttccactttcacttgatagatagatatgatggtcttttcacaaccagcaattctgcatgagctagttcttcaattgataaatgaggggataactcgtgagtctttgattagtaaatgcttatgtttatagcctgacgtcattggtattacacctgcattaatcactttgcaaaacagacccttgaaataaccacagtacagagagggtaatctagttataattgataggacatactatccagtcttcaaaatatgtcttttttttcctcagactacagctgtacataaatgaacctttgatctatgcacaatatttttattcaagaaagtcattgaataaaatattgtttatgaccccctttgctttaccctcttttttttttgtttccctgctttctctttctgatggattttcacagcaaaaaagggcaaaatgaagggcaagtattttcttgttgctcaacttctttctgtttagtacacttgacatttccactgatattttccttcctattggatattatcctctgtgcttctcatttgctaaattttccttcatgatcactcaaaacttagcagcaaaaaaatggtagaaagaatatgctgtgttttcatatgcaagctggttcacattcaagtttttttcttggacttaagaagctttgttttgtatccttccacttactaattcatacctaatatgaggaatgttattaactcactaaaggcattaatgagttttttaacatcattttctggatcataatattggtaaactttatataaataattggtctttaaaatacctctggtataacattcatatcaatcactttttaaaagatattcggttatagtagggttagatcagaaaattatagacatagcattttctttgaaataactgtggggatccatgttatgaagttaatccatgttataattttattattttgggaagcattgaggacatttatattcattgatatgtttcaattttaggatgtaagtactctattttcaatttttcttattaggtaatctttctcatgccttcttattgttatagaatctctggatatatactctgaattacctatctaatcctgtaacattatctttgcagattcggaaaccctgaagccagataattttgaagaatctggctatacattcatagcaccaaggttggttttgttgtatttttgatacatcttctatcagtagctaggccttcaacagtagttcagaattgagtcaagactgctctgggttagttccatatcacattatggaatcaaaggaaataattactttaaaactgaaacaaaatctttatttattcatttctttactcattcaaatacgagaggccgaagctggtggatcacaaggtcaaaagatcaagaccatctggccaacatggtgaaaccccgtctccattgaaaatacaaaaatttgctgggcatggtggcacacacctgtagtcccagctacttgggaggctgaggcaggagaatcacttgaacccaggaggcggaggttgcagggagctgagatcatgccactgcactcttgcctcatgacagagtgagactccatctcaaaaaaaaaagcaattactatgtgctaagcaatgtagactctgggacacaatgggaataagatggacataggctttgctcttgtagaacaaacagtgcttccaacagtaatagaaaattgtgtatttttacctgtgaatatgtatatacacatatgtacacatatatacacatatatgtaccaatatttatgtgtatctatacacgtaggggtagaatgaacataataatggatttttttaatggtctaattcaactttctgggagaacatgtttacagtggcattgctttacatagctttttagatgcacctcatttctttctacccaattttatttatctctcatataatctcccttcatcacgcatgtacatctttttctccatctcagttttcttgtaattatttgaaactattcagtagtcccagggtgttctttattcttctttctttcctcagtttttgactcctattccatgacagacacatataatattcaaatataattcctattaatctaggccaaattattgggaacaatttacatagaagcttggattgttaatttttcacttttcttaaattattccaaaaactcaaagatgcatataaattgttctgagttaccctttaattcttgcaaaaggatatttctgaattgtttctactttaacgtagggaatatgggttttttgaaaaatctctgttaacaaagcctattcttggctttttgaatgcccgtatccttgagaagcttctcttgcttgaatttcctttagtgtgtgacgctgttgatcacgctgtcctttgacagtgtgctttctcttgcttgatgacacactattctgtttttcttactccctctctggctgcatattcactgtctctttcatgagtttcatttcttctgctgatcactcatataagaaggctgcaaaggatgctagcctaggctgtctttttacctgagactgcattcagaccacaagccacccatgtgttctctgcctacaggttaggttcataattcccaaatctatatgatggccataaatatctagagacaaagacatatgtgtttcattgatattgcattatattatttaatcctatattatatctatttccagactttacatatttcaatatgagacacatctcatggaaaccagacaagagtatctcttcaatgtgcttcagatttagcatcttataaataattgtttcctttggaaagttctacctatgttgcctcagaggagaaaatgccatcctcccaaacgagcaatcttgaaacctgttagttgtccttctctgcttcctttctcttgtatctcacttctaatcaatcaccagtcttgccagttctgtcgtatgagtatcaagtgtatctgtcaatctcagctgcctctgccctaatccaggtcactgccttctctcacctaaactactacatttgcctcttacttgatctccctactttcatatttaccctgtatttcttaatgctgtctctgttctgtaaccagagagtttctaaaatgtgaaaaaaatcatatttctcatctgctaaatacgagccagtgattgtatattgtctttatgattatctgtgctttatattatagctttcaaatgctcttccaccaagtcctggtgtaccagtgtggtcccccacactctaaactatggaccatcaaactacatcctgtagatcagctatcaattttaaacataaatttttgttggagcacagtgatgcttatttgtttctggaatgtctttggctgctttttctacaaagacagggttgagtagtcgtgtcatagaatttatgggccacaaaagcctaaatcacttgctacatggccctgtcagggaaagtttccctacccgtactctaaatttcatccatactaacgtctttcagttcctaaatgcactttcttttttttttttttttttttttttttttgcttggttttagttttaccttcttttttccattaattctcttttcccttttggactacacacacatacatacatatgcatcccgctccctccgaaatcccaacttaaaaattcctcaatgtggggatttctttcctttcttcactggtatacgcatccttcctgactgcttcatagaattctctatttctcttggggagcactggccacattttatttactttcctcaacagaccatgactgtgtctatttgacttaacattcaatacccaatagtgaatccattgctggcacacagtaggtgctgaataaatacttggtgactggagaatctgtaaatatataaagaatattcttaaaaattgtatcactaataatacttgcaatcttattagtagtttttggacacaagtcactttaattaatttcaagttactttgaattactgagaacaactttaacccactttaactagaaagaattttctcagtattaaggagaacattagctagaaaaaacaaaaacaacaaaaacagggtcccgcagaatattaacatagcaaacaatttaggaagagattgaaattaggcctgctatgttggcaagactctccatctgaggtctgtgttgttgtctacagtttcttcccttgtctctcccagttattaagtagcagattatgcatgttggctttctcagcttcactataagacaaggtggaaactagggtagaatccagatacatagagaaagatagatatatctctcaattctaattcctaattcataggcagtggattttgtttaatccagcaggtattagtgtatgaaccatttctgtagtcagtgtcacatttcatatttttttttacaattcaaagttttaaaatatatttacatatatgtacaactatcactagagttaattttagaacattttcatcatcataaagagaaaatctgtaaccttaaatgttacctacccatccttccccaaccctccccagacccaaacaaccactaatctattttctgtctcttatggccatgtgcttgttctagacacgtcgtataaatggaacaatacaatacgtgaccatttgtatctgccttatgtcacgtagcatgatgttttcaaggttcatccatgttgttgcacgtatcagtactttttttatagctgaatgatatcaatacagctgactagaagatcgaaatttacttacgtgtttagggaaggagaaagtacttgagaagggagagtatttggcttgtgggacaggccaatgaatgtccacttcaattaacatatgttaagccctttatgggcttgattataaataaataaataaatatatatatatatatatatgtgctgttttgaacagtgtgtgtgtgtgtgtatatatatatatatatacactttttaaaaaaaatttactttaacttctgggatacatgtgcatgacgtacaggtttgttacatagttatacatgtactgtagtggtttctgcacctatcaacacatcatctaggttttaagccccacatgaattagaaatttgtcctgatgctctccctccccttgccccccaacaggccccagtgtgtgatgttcccctccctggtgtccatgtgttcttattgttcgactcccacttatgagtgagaacatgcggtgtttgtttttctgttcctgtgttagtttgctgagaatgatggcttccagcttcatccatgtccctgcaaaggacatgaacttattatggctgcatagtattccatggggcatttgtgttatattttctttatccagtctatatcattgatcagcatttgggttggttccaagtctttgctgttctgaaccgtgctgcaataaacatacatgtgcatgtgtctttatagaatgatttataatcctttgggtatatacccagtaatgggattgctgggtcaaatggcatttctggttctagatccttgaggaatcgccacactgtcttccacaatggttgaaccaatttacactcccaccaacagtgtaaaagcattcctattccaccacatcctctccagcatctattgtttcctgacttttcaatgatcgccattctaactggcatgagatgttatctcattgtggttttgatttgcatttctgtaatgaccagtggtgatgagctttttttcatatgtttgttggccgcataaatgtcttattttgagaactgtctgttcatatcctttgcccactttttgatagagttgtttgtttttttcttggaaatttaagttctttgtagattctggatattagccttttgtcagatggatagattgcaaaaattttctcccattctgtaggttgcctgttcactctgatgatagtttcttttgctgtgcagaaactctttagtttaattagataccatttgtcaattttggcttttgttgccattgcttttggtgttttagttatgaaggctttgcccatgcctatgccctgaatggtattgcctggattttcttctagggtttttatggttttaggtattacatttaagtctttaatccacttgagttaatttttgtataaggtgtaggcaaggggtccagcttctgttttctgcatgtggctagccagttttcccaacaccatttattaaatagggaatcttttccctattgcttgtttttgtcaggtttgtcaaaaatcagatggttgtagatgtgtggcgttatttctgagacctctgttctgttccagtggtttatatgtttttgtaccagtaccatgctgttttggttactgtagccttgtaatccatcagataaatagaaccaatgacaaaaaccacatgattacctcaattgatgcagaaaaggccttcgacgaaattcagcaccccttcatgctaaaaactcataataaactaggtattgatggaacgtatctcaaaataataagagatatttgtgacaaacccacagccaatatcatactgaatgggcaaaagctggaagcattccctttgaaaaaggcacaagacaaggatgcactctctcaccactcctattcagcatagtattgtaagttctggccagggcaatcaggcaagagaaagaaataaagggtattcaaataggaagagaggaagtcaaattgtctctgtttgcagatgacatgattgtatatttagaaaaccccattgtctcttcccaaaatctccttaagctgataagcaacttcagcaaagtctcaggataaaaaatcaatgtgcaaaaatcacaagcattcctttttttttattttttgagatacagtctcgcttttgtttctcaggctggagtgtaatggcatgatctctgctcgctgcaacctccaccttctgggttcaagcgattcacctgcctcagcctcccaagtagctgggattacaggtgcccaccaccatgcctggctaattttttgtatttttagtagagacgaggtttcactatcttggccaggctggcctgaaactcttgacctcgtgatctgcctgcctcagcctcccaaagtgctgggattatgggcgcgagccactgtgcccagccacaagcaatcctatacaccaataatagacaaacagccaaatcatgagtgaactcccattcacaattgctacaaacagaataaaatacctaggaatacaacttaaaagggatgtgtgtgaaggacctcttcagggagaactacaaaccactgctcaaagaagtaagagaagacaaaaacaaatggaaaaacattccatgctcatggataggaagatcaatatcatgaaaatggccatactgcccaaagtaatttatagattcaatgctatacccatcaagctaccattgactttcttcacagaattagaaaaaactaaatttcatatggaaccaaaaaagagcccatatagccaagacaatcctaagcaaaaagaacaaagctagagacatcacgctacctgatttcagaattataaattttattgaagttttccccttgagtgcatgtcttttaatattatatgtgataaaactagaagtgctactgcatcccagagtaacttggatgtctcaaaaaaataaaggacctgtatgattgtgttaggaagtgaacaaggtgctttctgcttttttttttttaatgtaacattacttgaaagaacaaattacagaactatggttattcagatttggatagccagcagatagtttctcaaaaataaatcagatgagcttttgacttcgaagaaaacaactaagagtatttgctgccaatgacagaaactgagctttccaacgaaaattagaattttgggaaagttgtatacatgattcattcccaatacttacttagttgaagataataatgagtgtaaattttcaatattgtataatgtgtcattatttggaagttgtacacaactcattttctaaataaccagtttatgattttacaaaatcacggatgcttaaaagattcatttaaagtataagaaagaatatggaattttaatgtaacagaaggcaaaaaaactattaatattgtttcagattccatgttacaactacccatcaatgaattacaaataaacaagtttcagtatgttatcaaaaacagaacagccgcaatatctgaagaaaaacaagcctctcgtctctgtgaggacaaattttctgtatagaccaaaacaaactcttgcaattgattgcagagacatgcttgtcttctcttgtcaggaattaaagataatttgcaaatatgtaaaacattgccactttttaaaatattttttaaaataatggtaatattttattaaaatatattaacatgtaatgaactttaagatttctgggcttttttattgtctaaatttttattttcagacagtcatagattcacatgcagttgcaagaaataatacagagagaacctatataccttttactcagtttcctccaatggcaacatcttgtataagtttaacacagtatcacaaccaggaaactgacataaacacaatccactgatattattcagatttcactagctttatgtccactcagttgtgtttgtatatgtgtgtaactccaggcaattttttttttattttaagttcagggatacatgtgcagaacgtgcaggtttgttgcattggtatacacgtgccatgttggtttgctgcacctatcaacttgtcatctaggttttaaaccccgcatgcattaggtttttgtcctaatgctgtccctccccttgcccccgatgccccaagatttctgttttaattgctatatgagactcctaaatctaagatatacaatgataatagtataactacaccaaaacttattgagcacctactgtccaaaggccaaacgtttaattcatattgcctataatcaccacttactggtaaagtattggtccattatagaagtgaggaaatggaagtaacaagaagctcaatagtttgcaaagtcttgtggctaataaaaaaaaaaaatagtgttttcactacctttaattaccctgtaaagttttgattttaatatctaatatctcaaaatgtttttttttcagagattactgcaatgacctgaaaatatcggataataacactgaatttcttttaaatttcaacgagtttattgatagaaaaactccaaacaacccatcatgtaagtatgcattaattcaaaatgattgcttgagtgtggttctattggtttatagtatatcataggatacgataatcatattactttatattgtgctggttgtttatttactttacaactttttaatagtaaaatgtaacaatttgatccttaattttgcaaactaaagaaatgttatttcattatttagttaaatcaaattttcaaaacaaggtaatatattctttcaaatggttaaacgtaaatatggcacgctcatgttagctcctctcaaatttaggaaatttaattttgaatgatcttttgaaggtttttttatagcattttgcctggtagaggaaaacgtacatttttataaatttatttatatgcttcaaataatataatgagttttaatatgggtagaataaaaaccgaagtataaagaaatatcacttaatgattttcttccttcctgacattctattttgatcacaagttaactttatgtcttaaaaaattatgcttctgtaatttttcatttatgaggtaaatcaaattaaaatagacaacagaaaattagtaattagtttttaaccattatatttgtctttcaggtaaatttgcatcattcatactctaagcttaatagaaaattatggattcttggcttttaaatcattaaaaaatctaaatcattttttcttctaaaaatatttattataaaagcactaccaaaacaaataccgtacaaatgggaaataagaggaaaaccaaattcatggcaaaatttatcttcataaataaaatttgaaaaaagaataagtacacataattgacttttttggttctctctcaaagaggagtctctttgttctcttctccctccctccctccttttccttctcctcctcccttctttttgtttttcaattatttatctttctattaggaagggtcaaagcactttatcagttatcaaaaaggcaaaggctttcttaaagctgactcttaacttcgatttattgcatatgagaagaaataacttcctagctccttcactttagcacagattagttagcggcttcagtgagccactctgaaaacctgtcatgggagccagagtttacattgatcatgtcttaacatgatgattccaaacctttctactcagtgcaagctcactgagactgagccagtgcctttgaaatgttattttatgtcattgtttatttcctattaatgagtactaggcatttccaagagagaactgtaataagattgttgaatgttcctttaattggataccaaaattatgaaacactctcatattccttgcaaaaatgagtttatcagaaatgtttttcctaacatataacttttcagaacaccatgaaaattggaatcattcttttttatatctgtatctatttattttgttttacctaaagggattggaggcaattagaacatttactttccaaatgaactgttttttaaatgattcagtttctaaaacaatatagtaaaaaagagtgtctagaatgaattaaaatgtactccaaaatagggattacattgatcctttaatcccaggtgtaagatatattaacttaaaataattaaaagcaacaaaaatgtttccagcctatctcaccaccatgttgtatagtaataggatgttaagaacatatattctttatctgaaaaagtcaaattttgtcgtaaatgtgcaatttcagagggtacctgttagggtatttcagagcttaatgggtttagaggaacaaggagaatgggaagaaggcagaggtttttgtttaagaatacataataattggcctttgatcctcatcacctgtttcctcaattatctttaaacttgggctaatatgcacttcagttattctagaaatgacaacctattatctacttaggtattggttctttgaccaataccagtagatttcaaaaacattcttgggattgtactgctctgtgatgctcattccattccttgctcctcgatatgcggcactgaatttttcatagtcttatttactccaagattatcctatgttttgatatttgtgatagaaaagaatgaaaatagcttttcttataacaaatgaaagtgaaagtagacagtaactttttgttgaatgtttttacttgataatttcagtggtagttctgtttctatatatataaattttatatacatatataaaattttatgtgtgtatacattaaattgtcataaaattatgatggttgggaatcgccatgctaccatacagaaataaacaaaaacacaaaagaaggactatttcctgtttcttaacatagcttatttcttattttgataaagtttacaaaataatttggctcatttagaattgatttttctactactaaatccattcatttcctgaaaaactgtgaggcaagatgaacaatattaaaattacaaagaaaatgaatgtggaatatattttaaaattcatagaaatatctactctaaattgcttttggaaatagaaaatatatttttcattatgatcataattttagaaatgtgagtgtaactgatgatctttttctgtgttaggtaacgcggatttgattaatagagtcttgcttgatgcaggctttacaaatgaacttgtccaaaattactggagtaagcagaaaaatatgtaagtatttgttcttattaataaaaatatgtattctgcatttcaatttagtttctcctgtggaaattgggtatgaatctcataaatttacagttcattaataatgtttaatatttctcaagaaaatcactatacagttgttgacaacttgcattttcagttgtgggtgtttttcagtactaatgtctgctattactcaacttttcatgcacatacacttcagggtgaatacaccaaattaaatgggcatgattgtgtgtttctgtttgtgctaaagtaggatttctagtcagtgtttatttgggtttctaatagcattaccatacatccagttgagaaaatctgagtatgattcttatttaaaatctcttctccaccccattttcagtcactaaatgctaaatatttctcctagcaatgttttcttctctacctcataatgaaggccctaagatcccatttctaagaaatcacagcaactgatttttctgcctttagtgttctccattcctccacatgcagcttctagacaattctccatacaactcatattggccagaatctaactcctaaaatgcagttctaagttcaagatacaggtgaagctctctaagatggaattcaaaatcattcattagctgaccattgaggaacttgcacttgaaactttacttcttactgtttctctccttttgtcttacgttttttttctataccaaacaccagccatctctggtagctttcccttatgtatacattcctctctacaagtgataccttcctgctttctgtgtcattgctgtcaattcatactccatgttcaaaatgcacctcagtcattatttcctatgagatgtcttccttaaacatccttcaagtacaaatttaatagatatttaaattattaaaacatagttgtgtatctattgatatatttcctttacttcctaaacttacttctctttgtatcaccaacacctaactttgttttttagaatatgttcaatagaacatttccttgttttgtcttctgtttcagcaagggagtgaaagcacgatttgttgtgactgatggtgggattaccagagtttatcccaaagagtaagttcaaataacatctgtaaaaacaagtacattacaaaagactgcgccaaggatttgtacattactgcttaaggaagccattcttcaaataaactgattgccattagattacattggagccattgtttacagtatttacattattaaaagattttatttctctgaaaaatgacattataaaattcttcaatgatgtttttgcttgccaaatatgtttattacaacatttaagagacgtttaaagagatttttctctttgtagatacaagctaaaccagtgaaatgaacacaatgattataaccaatcagcaatatttatgtagcactttattatctttcactcttctttgatgcatcttatctctattatcttcgtaacagtccatgaagtaggctgagtaggcaccaatgcttactaacattaattgacctattaacttacttgtcctgttacctgactagtaaacaacggagtaaaactaggagttagctttttctgattcttaatttagtgctatgctgatgcattgctcagtaatgagtatcagttatgctatcaattaccactaacttctttagacatacctgagatgtaggcgtatctgtaaagctcagcaagtccacataggataaagtaggttatcaggtagattaaagaatacaaatgatgagccatttcctccttagggctggagaaaattggcaagaaaacccagagacatatgaggacagcttctataaaaggagcctagataatgataactatgttttcactgctccctactttaacagtaagtattgctttggaattcagcttttctcaattttttaaataataaattactgctactatctgctctccccccaaatcactacattttatgttaactactcagaatagtcatcattaaaaatagagtatttgcaaggcattaggaaaatagaaaagaaacatcatttagttgaagaagcaaaatgcatacacagcaaacagtcttccagtaatttagagatagcatatctgttaggcatgcataagaaatagaaacacatgtagataatccctcatattacaactgaaaatgtattgaaaaacatttaaggaattaaatagagtaattccattgattaattacattttatcagtattataaaatataattatacaattaataatagcttatcttttaaaatattttattgacttatttcccaaaaaccttgtaatttaatccctgaacatctttgcacataggtagtatttaccttcattttcctaaatggggaaacaagttcagagaatttcaaagttttgcccagtgacatacgtcttataaaagacaaagtcagttttatgcatccaggatcaatctttccacttcacttcagcagaactacttaatattttaacaaatgttgtgaagtagagatttggcatgtattcattatgttgtgaaagcagatgcaaccaagctaattaatgtccccgaatcaattaatacaaaccaattcatggatataccagttagcctagtgtatacaacggaagaagagaggaaggagagcacaaacattttatagtttgtagatgctagaatttttaagcaaaatactatccatttgtatctaatgacggaaaatcaatattattattcaatatatcttgataggtgttttatttatttattttttttttagaaagtggacctggtgcctatgaatcgggcattatggtaagcaaagctgtagaaatatatattcaagggaaacttcttaaacctgcaggtaaggataaatattaaatacaaaaacacaatcaaaattaaatgttacttggcatttatattataaactggcaatgtttatcaagaaggtcatcaaaaggtgtcaaacaaaataaaggcatgcacacttaaaaaaattaaataaaatatgactagttacctctgaagttgggataaaatcaaattgatactacatagatttgaggaattttcaaaacagtgtgtatgtttatactctgacacaaattgatggaatcaatttagtataataatcaaaatttttaatgttggattagcaacccacctccagaagtctctcttaatactttaaaatacgtacaaagttatatggccaaggagttacatatttgtacaaaaaagttaagtttccagccctgagggaaaagataaatatggcatatttatactatattctagtaggcgtctgttaaagtgaattaggtagggctcagttaaaaacttgctataaaatatatagaaaaatgactttttggaaaaataggcaagtaaacaaacatagtaaaagtgagcattaatgaggatcggaagtgggctagagtgagtgaatacaataaagtaaaagctattagtttttttgattgtatgattcagtgtttgaagttttaaaggagagtattttgagccttcctgctcctgaggacagctttaccccatcagcggatctattacatgaattcactccatcacttactcactaactcacttacctattccttcattcactcaattgctcaattacttactaaatcagttattctctcagccattcatttattcacccactctcctactaacccacctactcatccattcatctgttcactctttcagcaaagatttattaagcacctactgcaagcactggtggggttagggaaacatcttaaaatataccgtttgaatgacctcaagtttatgaggctctcctgacactactgttttttatttagcttattgtattagttaattggtcaggttgtggctaatgaatacactcttttgtgaatatgttacaatttatgtaatagtttaagagctattagcattatttcttaatgaacacaaaactaaaacttctgtaataaactatagtctgatacttgctatcaaaataactgtcatattgcaaaggttgtattacatctaattatacctttgaattaattcaaattaatttttcagttgttggaattaaaattgatgtaaattcctggatagagaatttcaccaaaacctcaatcagagatccggtaagatatttttaaaaaattcttatgctatgtttaatgttttcaaaattcaatagaaaaaaatataaggtccttatacagtggcaaatacattctcaataccactacactgaagtagaattctgaattcctattttttcaaagctttttttgtttaaattagtcaatatgtaatagaagtatttcaaggttataacatgcaatgctagtttatatattgattgacattgtctaataagataaaacttttgtttcttatagactagactgtttaatcttatttttctactggataaattatttcagaatttctaattataacatggtaataatataattaaaatccaacttttaaaagtgaggtgataatcgcatttttgtctttcagtgtgctggtccagtttgtgactgcaaaagaaacagtgacgtaagaaaactatttaaaatcacttttgagtacaatatttccttgtgttactcttgctaagactatagtgatgaaaaaatatgcaggaattttttaatcaaaggctaaaaaattctatggaaatgtgaaataatatattcatttgaatttgtatgcttttgattttgaatgtaaagtgcttgaatttttaaaaatatgtatgtatccttggaaggtaaaaaaatggtcatgtcaatatgatggttctcttcggtctcaactgtgttacattcttttgtacatatttatctttagctctatttctggataggaagtttctaaccaaagcaaccctattggttatcaatgcagttttctctcacctatcacactttctctaaatttgttcacactgtattatatagttacaggaaaaatgttttaactaaacctggaagtattacagtttattataaagttatagttacatggattgagttttaaggtgtcttgtattactttcacttctgtttgagaaattgaaaaaggaaatgtgaactttgttcaaaagttgaagatgctctaagaatgatactagataaataattctaaaaattgaataacaatgatgaaacaatattttcttccagtcctcttttgtgtgtctgtatatctccaagggaagcagggggttcatatcgtctttatcactcctactcctgtgaaattatgagccaataattttaatgatttttgtaacttatctatttcacatagactatgcagtagctgttttaagagcaaatattttagtaataaactgcttccacattaggaaaatgcaatgcattacatcctcaactttgaaaaccatgtttttatttgtgatttttattcaatacaaattattatattgattttcatacattaaaacatgatttaaactaggtgggaatttatcctgtgtttcagggtgaagtaagtattaaccatggacattttttgttttgcgttttgcttttaaatctccaattatccaactacatatttttaatctaaaatatgaaataattataaatagtcttatagtactgatgtgttttaagtctgtgaaacaggacaactaaaatgatatttttttaaaatatctttttgtcaaaatcctaagtatgtgtttaaatcagttactcattattaaataattttctctatccagttttctggatcatttagatgacccggaaatggtaaaaagattatttctaatttgctcttctgatttgttcagactgaattgacagtctcaagtggatggttggtgttggattatcaagcctgatggtttgatataaatctatgcatgcctttatttcaccagaatttaatgaacatatatgttcaagagaagataggcatttaaaattttctatttttattgctctaatcatgtatataatggggtaaagacaatgcagcctcctaacctttctaaaaatgtgttaactgttcactttattttgataggtaatggattgtgtgattctggatgatggtgggtttcttctgatggcaaatcatgatgattatactaatcaggtatgtacctcaaataagagggaattaggctttccaaagtgtgtttcccggatcaacattacaaaacctctttcagtgttttagaaatcgatgagttgttttatttctgtcatacaataatttgtaaaatgcttaatgttatgtaaaccattaagaaatgcatgctaagtctagtttttatgttatttgattttacattttagtactggtatcattaaaacatacagttaaggattttagcatgacatgaacttttaatctttctgatatttagaaaactttcacttcaacatttgtcagttgatggtatctaatttaatatatagcttgttaaaactgatgtgatttctagtctcaaacctgcaaatgagcagcacataggctatttttaacaaatttgaagtagatgccaactaatttcacttctgaatctgcattcctggcttctttcttttgaaaaaacaaagcaaaaatatctcaaccctgggctttgtttgttttttttctggatgacaggatttatggggtggagctgattcactcatgattgcccctttagatgggacttgttccagttcatcacagcccctacaagttcgttttctaggccagcctgctctctcatttatgccacttttccattccccaggggggcatttgatcttttttttattgtatatgtttaaggtgtacaaaaaaaagctttgatttgcatagttaagtgattactgcgtcaagccaattaacatatccatcatctcaggttgttaaccttttttgcggtatggtaagaagacttaaaatctactctcatcaaatttctggtagacaacacagtattattaactacagtcctctgttgtatgttgaatctctaggcttatgcattctacataactgcttctttgtacccttccacttatacctctccattccccggccctgttttattcatctgggaagcatttgattgtgatttaatgcttagtaatgtgtgtccattctttccacaaataaaatatcacacagccccactgagtaatgagaacacttactctcattttagtttgttcacagtgtcatatacacgtttctcatttgcttttgtttttaagctcctcagttgtagttcagtttctttgtattatttcttttcactgtagtggtgattcccgtgttcatttttggcttacattttaagtgcacgttgctttatgatttttttcttcaccagattggaagattttttggagagattgatcccagcttgatgagacacctggttaatatatcagtttatgcttttaacaaatcttatgattatcagtcagtatgtgagcccggtgctgcaccaaaacaaggagcaggacatcgctcagcatatgtggtcagtaatatccacggtctaatcaattctcaaggggtactcaagtgtcctcagtatcaagtagactactgaaatgaccttattattttattttatagccatcagtagcagacatattacaaattggctggtgggccactgctgctgcctggtaagtcaaaattttagttttattggtaatgaaagaaagaagttgtaaaataaaaaagcatctgatgaaaatatggatttaggggatattcaaatttttattaagggagttaagttgttttcattctttacatcacctattggtaatatttatagtttttcctaagtgaacactataaagttaccattattcagtttctcatatgaaaacaatgttatgcggatgtaaacttcagcctctttagagtcttccttcctctacatatctattgaaactcttttcatttgtattaaatatttataaaaacattacactaatttcttttaggtgtattgatctgtaagaagttacaatttgtctttaatatcccagttggatgtctacatgcatcaaattcatggcatgatggcaaccttctacctctttactattgatacaaggactagtattgttttaggggcatcaggttgccgacatggatctaattatttcttttcactgatgctaccttccaaacctccctcaaccctcacctgtagaccctacaacctatgaaaataagacatttaaatggtcaattgtggcactgtggaaggtctggaagatcacatttctcattgtttagttgtaactaaacctcctgttacgtctggaatccatgatctccctcttccctctctcccttctaatctttttttttgtatcatcacactgtattgttagccctattccatgtagattaatgtacaatattcatttgatgttgaggtttgcccagctaaaattaagtgactatatcattaaagcagcaaaaaagattttaaaattttgagagtttttaaaagatttagaaaattctgttttattctgaaaaatggtattttctgatgtgattttatatattaatttcagtaggcttttaaaatttcatcatgaccctgaaatacttggctttatcctatatcccctcccacccccacttttttttaaactaaattcagttctagaaatttggctcagttgtcagttactgtaaaactgaaatgtgctgtatctctctaatatgtatattttgtttcatgaaagttacattacatatttacaaatatattctatattacaaagtaaatagttaacaaattcaaacccatggtataaacagcattgtttctttgttgggggcgggggaaacccaaaaaacaaatggttttaaaaactaaaataaggagacgtaatgaatgtgaaaacctacgcgctgaaacagacattctccctcttagagtgaactcttctgcttgataacattgcctgttaggtttcttcacacattgtgtcccacttgatcctgaacaagatctgaacacttctgatttcatgacttcttttacacattacaaaaaggttacaatgtgttatataattttgaaaatacttaaataaaaacactccaagactttctttcccaaaaagataaagggaaacagtatttatgtgtatgggtacatgtaaaaacacattttttccctagatgtttattttttttttatttgaaaaattcaggtctattctacagcagtttctcttgagtttgacctttccacgactccttgaggcaggtatgtaaatgctcagaccttgtcattgccataacaataaaaattttcttttgggatgtgcttgaagttcaacaaattcagagaatatttgtgtgaaagagaaaacaggtcacccatctcataattttagagctagaaactttttgtccaacctttcctaatgttttagaaattacctaggtcacacgggcctgatctcatagccatcttgtatttgaattcatttattctcttgatatttatcaggcatctattacgggctgccacgatattacacagcagtaaacaagccagtcgaggggtcctggtcttatacgtttattttgctctgtgagaagtgaagactcgaggggagtgactacagagacccctcctaatggtgttctttgtttttacaccgtcccccgccacccaagttgagatggaggatgatgacttcacggcctccctgtccaagcagagctgcattactgaacaaacccagtatttcttcgataacgacagtaaatcattcagtggtgtattagactgtggaaactgttccaggtaatttatttatttcaggagtagtcctatttcattaagaaattgtatatactgttataatcattaagaaattgtatatactgttataatcattacagaaaaaactgaaaattgtgttggagtcagagatgtgagtaattgttttaagctgaaaatgtcagcaatctttagtttctctgtagacttttaaaatttgtaatttttaaaattctaactttgataagctgttatttcttcaactataataattacatgatcaagataattcctttctctttaggcagaacatagagaaatttgattatattttaactttttttcctaaaataacccatattaaaaatttctaatataaagttattaaatatattagtaatttaaataattctaagccaaatattatttatttttctatatagtaactaaacagatttacaaaaaaaaagtcttgttttgttttgtttttacttctagtcttctctgacttgaagaactgaatgttatctttatttgaatttgaaggaactgggaaaaatacagtttttttaggtcatggttaatgttagtcagtatccataaaatatcttttaaaaagagatggagaatttaattttgttgtaatgagggtagaggagaaaggcaagatggggattttgaggggaaagtaataattaatgccacaggattcctgagaggagagcagcaagtcacagcttacaaagcacagagtagagacactttgtttttagaggtggagggaagattattctagaagaaatgttaccatagcggaagaagaaataggaggaggtgaggtaatctgagattatgaaagtgccagaatagttaaaaaaaaaaattttgcaagaggggctaagcaacctatcatgaatttttaggagacgtggtcagtatgttttatgactttctttagcagacctctatctccaaggaggaggtagagtatataaagaggagaggaaagggaaggaagagtcaagcatgaactcagaaaaaaagcagactgtcttgtttagaggagattagcatatcaggctatggacttcaggaaatgggattgtggcatgtttattggatacatcagagtttcacagacattggccttttattaattgacatccagcaagagcaattggtgtgcttaaagaagtaagttaaattgtaaagtgaagaaggtcagtataaccaagatgttaaattgcatcatactttccttttgatttgctttatggaaatcaaagcttaacagggcaaaaagaaaatcccacttttctgcaaaatgtataatgataaagaaattacttttttagtgatatatttacattttttatgttggttactaaagtaagagcagcttaaggtgtggacaaaacaggggatggaattcaaaacccttgattctgtccatgtctgtgttgcccagtgcagtagttaccacctataggtggctattgaaatttcaattacagttaaattaattagaattaaaattttgtgcctcagtcacacttgtcacattttaagtgcccaataccctcgagtggctagtatttaccatattggacagtgcgaacaacttttccatcttcacagaaagtttgcttaatagcactgttccagacttttctctgcccttaggttgggcaagatgcctagacatttttgtattccctgttgtgttatctgtaaaataaggcaactttggcataagcatcacaattctttgtatgtgtaaagaaaaacttttttctatgtacatcaacaactaaattgtgcttattttgcaatgaggattaatactttaaaatggtcacacataaaacatatattgcaatttttttattcatttgacataggtaatacgttcatgctaataaatgaagcatttttttcttctaaaatcatactcctattgtgctgggaatggtttctgtttcagatgtcatattttgtctttcattttaatatgtaagaatctttgaaagatttccatttattttggaaaagatactcattttctatgataccatatttattttgcagaatctttcatggagaaaagcttatgaacaccaacttaatattcataatggttgagagcaaagggacatgtccatgtgacacacgactgctcatacaagcggagcagacttgtatcctttgacatcagagctatctggaaaggaaaaccatcttaatgcattttgaatcttgtcacattgtttatattcataaagagaaaactattagactgctctgatcacctcgcaaaggcagaatcgattcctcactcaaaatttggttggaatgtcaagaataattatgctacacatgccccagaaaaggataattcacaatttagttctttaaatccctatgtacttgaattgtgttggatgagagtaatgatgtataagttatctctctcacatgttttgggaaatacattgcattgtatttatttttaatcatgtgaaaaaaactaacatgagattccttaacaagtctcttttagctgacggtccaaatccttgtgacatggttaagcaacccagataccgaaaagggcctgatgtctgctttgataacaatgtcttggtaagatcacacttctactggattaaaatactataaattaatggtcactgtccgcaagaattcaaggatacaaattgcaattttaactcaaacgtaatgtcttaaccatagtttttctcattaacatgacatacttgctggtagatttttttcatttcagtagttttcatggttagcataaacttgacagttgcttcttttatatgtccttcccacagaaattgtgctttcaaacacaattccaatcaatttaactcatagtaaatgttaattatggtatatttgttgcctccatttatattccaatcctgaagatataaaagttaattttattatatttttgttagttatatttgtcttcagtgaattgaaaaacctgttatacagccattgtcttattattacagagttctagtgtgaattgaaaaacctgttatacagccattgtcttattattacagagttctagtttcttttggatggtttctgatgctatcacatattagacttctattatttcctttaattgtactaatttctttttctagtgtttgaaactagaccaggtcaattacatagggtttgataaaatattacaaatcatatttaatatatgtcacttaaagatggcttactacttttcctatagttcagctatctttctctaataaatactattctgatttactgtgtattgattatatacaaggtaggtaatatgtcatcagtatgtactacattagctttatgcttttaaaattcttaagaaatattaatctattctcaaagatgaagtctacataaaaatctctgtctacctctttttaactaattttaaatacaatacttcctaattctgattcttcagtgtgtgcacacaccaatgaatatccaaacttgtaaagcattatctcataaattatttgagttatttagtttacctactcaaatacatagctgcatttgtcccagaaaggacaaaacattttcacagataatattatgcaattagataatataaattaaaaatagcacaaagaagtaataaaatcagtaatggggactaaaaatgaaagatgtattagccagtcaatcccagttatctctgtgagggattattgatccttgctagggagagtaattcaacattgcaactaagcgttttttttttctttttaagatatattaagtccagataggcggactcctgttattctgtctactgcaacttcagcacgttgcccatgtaaaattattcccccaaagaatgttttatgaagggccaagggtcatgtcactcattagagaaacttcgctcatcaactatttgtcaccagttttttgacactagaaatattaaattcagatgaacttgaaaagtgacttaaaagcctattgcccaaaatattattctaggaggctatatcttatgatcaagccattaaaaggatttgaccaagacaaaaatgttcagcaattgaagctcctataaatgggttgtgtgtgaaagtacaactgttgctcagtagcttggtgtgctaataatatcttgtgtttctttagcagtggagttattttggtaatgcttatttgcaatggtcactgtgaatctgctctggatggagactcacgttaactgccagcaaattgcatgaaatctcatcttgtatgtcttctgtgttttctttccttttcctatacttgctactttgcccgttattaataggatcaacttaagtgcacaacgagtcgtgcctgtaccatgatgtcagctcctatcttcattttactgcaagttttcatgtggtgtggatggtcagtcactttctctaatttttcttagtttttgtttttggcttgaaattctagaaaatcacccatattcctaaatctgcgatattaatgttcctgaaaccaggttattaaaatctcaggaccaatgttgttgttttgtaaatagctgatttcaaatggcatgtacatttctaatcctaaatgaaacatattcaatatttatgtaaaaatcatttttcataaagtttttgtgtaaaaattgtcattacagagacagatatacaggcttcatggtattttatgagaactacctaatgacaatttttagaggtggttatctcaatttatttacaaaagatgctaacacaaatttaatgcactctttcaattcctttcagatttttctactttttaaaataaatctgacttaaataactttttagattttttactctcaaaatattcttattgaaatattttagaataagtgcttctagtttctaagttcattttatttaatatacattatctagcccaaaattattaattaaccttttaagaaatttctgagttctctattcaatactactaaagagatgttttgggtcttggatttgcatttagttcttcatttactgttttgcaatttcttttctaatgctctggaatcatcatgatgtattactagagcacgcactttcgttgtgtttgtcattggtttccaagtagtcattgattaggaagccactagatggagatgtggccattactatgaatggagtgaattcacaggcaggggtgatagagggtggggagtagaatagcagagggagtctcagaaaataaccacaagtcttctggcataataaaagaatagttttcatggcaaaagacgccaaagtaaggaaacgttgctttaatatcttcatatacacattttaaaaattgatatataggcaattatttgaattattattaattcctgaaagaagttcataggtagtcaaccattacacaagaaaagtgtaatcaaattatatttctataattgtccttattttcccttttgattcaaaagcttacttctgtcaatcatagaatttttagataagatttataggttatcagttacactaaaaaatatgtaagtattgctcttgagtaggccagctctctttttacctttctcttaaaaacttatagcaacggctgggtgcagtggttcaagcctataatcccagcactttgggaggccgaggtgggtgcatcacctgaggtcaggagttcgagaccagcctgggcaacctggtgaaaccccatctctactaaaatacaaaaattagctgggcatggtggtcccagctacgccagaggctgaggcaggagaattgcttgagcctaggaggtggaagttgcagtaagctgagattgtgccactgcactccagcctagatcacagagctagactccatttccaaaaaaaaaaaaaaaaaaaaaaaatatatatatatatatatatagcaacagtgactttaaaatctttttaacctaagaccaccacccccccccccccccaccaaaataacattttcctattatggtactttccttgaactataattataaatctatcatggcaataattatatatcaccatggactcaactaggatatttatgtaccagataatatgctttataaattgtgtttgcataaaataataaatttctcaatggacaattattgacttgctttacttctttgattaataaatgttagctttttcatttgcttgagttttgatgaagtcctcatggtatggagcttcataattgtagaagtataatctatatccttctgatctccaaaaagaaaacatttgagattcctttatattattgtatcaaaggaatacataatatcgatgatgtatattttacattaacaaaatatgctttcagtatttaaaaacacagttatctgtatagaacagtgaatccacttagtgctatttgaatgttgatataatgatatcaaaggaagtattattttctctgaaacaattaagttgaaaaaaatcattacaaaaaatactgaaatgttagttggcagttgtttcccacattaaggaccataaaggttatggtctatgctccaatgtagtctggctaaaactagcaatttctgttggattaggttctgctcacaagcaaggtagaatggtagtataatctccaaagcctaccaaggggcccttatacccggtagagtccggaaggatatagattatacaaaaacagttatgaagctccataccatgaggacttcatcagaactcaagtgttcaaacaagactttttgataacaagtttatgaagactcaaaaagctaacatttattaatcaaagaagtaaagcaagccaattctgtccattgagaaatttattattttatgcaaacccaatttataaagcatattattgggtacataatctgtctacatttaaagagttgaataaatatactactacctacctatctcacgagttaatgtgtaagagtgttaaggtgacatgtcggagaacaaattatttgctaggggcattattcctattattatgcagtatctacatgcctaaaaatttttaaatatagattgtcttcaaagttgctggtggtaactttagtacagacttacctgaattcaaaagttagtccatgatttgatggctgtcttcaccagcgatttgcattttgaaggaaattaaatgatggctataattcagaaaaaaagatcaaaaaccttttagccaaatgaccagaacattttcttttgaaacatgtacttctaaatttaataaattaaaaattattaagcttgtactgtatgcaattagttgtcccaggttctgaatggggaaagaaaggcagagtaagagtttagcaacagtaacttcaaaagattttagccactggtaacgcatgctgtatgaagaaaactttggggcaaaaaccatatgaattttactatggtttagattttttaaagagtaatgagaaaggaataaagaattcttagttgatatctttaataacacagtcttttaagggaggttcccctataaggaagtctaataaaattagttttatcatattttaaaataaatatatatataatattggcactgcattctttttccattttaatgttctaaactgaaagtaccaatctgttattttctacttaaataatcatttaaaaatcagaccgatttattatatctggtcatggtgtcagtgggatttcagtctctataggacagaaataatgctgagttcctcccacatcagtgcatttgtgtagaatgtatgccataataagacttgaaatgattctatgaaatacattacatggacttgcaccatgcaaaatgcttgggaagacatgatcaggaaacttaaaagacacatttttcagtgtgaactgacatgcacaccacagggagcccaaataacttatctaaactaccacctcccaaatagaaacagacatatctcatcatcacacagaggaaattaaacaaaaattatatataaaaataaaaacagtgaaataagggccaaagagaatatttttctttccataacacatttgtagagtataaagatgacaaaatatgttattaatacacaaatgggtcttgtgtggtaatttttattcaaattaacacttaatcataactggggagtactcctgtttaagtgacaatgacttctttaagttaatacctcatagtgtttctaaccagtccatgtgtgctgctttattgagtacctactcttcatttatcaaatcgttgctatgtatctagccactcttctgtgtatgaaatacatttatataaagtatttgttttttttttaatctgatattcaattgttactggtaccctgttttttatctgtttaccctacctggagagaaaagcatctgaacaaaaagaacaaatgcaaaggcagtaaacagcttggcctgttgcagagaaagccagtgttactgaagcagagtgagtaggcgggagaggagaaggtgggaagatgagacagccaggctccagacctcataaggctttgtagacctcaataaagaatgtagattttgctctgagaatgatgagaaatgtcaagcagggagtgaaagaatgtgtggtgttaagaagactgctttttggagaagcgtttataaaagggcagagtagaagccatgggacaagtgagacagcttttgcaaaagtggaagcaagaagtaatggtgacttggacctgcagtagtgacaagcagtaagtttggggatgtattttgaaggtagagttagaggatggattcccagctgaaacccccactctgcaaaaaatataaaaaattagacaggtgtggtggtgcacatctatagtcccagctacttgggaggctgaggtgggaggaccacctgagcccagggaggtcaagatcatgccatgctatttactggtaccagatatttactgataccagaagaattatattaggggcaaggcaagtcaagtttgaaatccctatgagacatacaagaggagaaaggtagagatcaatgaatacacagaccagaggagaatacaggattgaacatacaaaagagtgagttattaggaaacggatgaaattaaagccataggactggggattagatcatctaggaacaaagtgtaaaggaagaagaagaaaggagagagaagtaacacctggaaaagtctaacattttagagagcatgaaagaaaggaggtcaagccaaggagagagacacaaacaagtttcaagaaaaaccagaagagtacattagccaaaggtacatgagaacgtatttcaaggagacaatgtcatatatttgtcaaatgcttctgaaaggtcaaagaggatgaagactaagaattgattattttatgattctatttagatttgggatgtaaattgattgaaactaaaattttttcatagattcttttctcccagctttctttcttcttaacaaaatagttctgctgccttaaaatacaattaaagaaataattttatttactgtgtggcagcactgtattaaatcctggtgaacaaaaagagccaaagttcttattctttgggagcttagaatctttgtaaaattatcctgaaagaaaattgttcaacctattattttgattcttagaacatctaccttggattagcagattctttaaagatgtttaaatatatggtctttcaaataatcccatcagaaagtgggcaaaaaacatgaatagacagttctcaaaaaatgatatacaaatggccaaaacatatgaaaaattgctcaacatcactaattatcagggaaatgcatgttaaaaccacaatgtgataccaccttactcctgcactaatggccataataaaaaaataatggatgtggttaaaaaaaaaaaaaaaaaaaaaacactttgtacactgctggtgggaatgtaagctaatacaaccactatggaaaacagtatggtgattccttaaagaatgaaaagtagaactaccatttgatccagtagtcccactgctgtgtatctaccctgaggaaaagaagtcattttatgaaaaagacacttgcgcatgcatgtttatagcagcacaattcaaaattgcaaaaatgtggaaccaacctaaatgtccatcaaccaatgattaaagaaaatgtggtatatatacaacatggaatacacctcagccataaaaaggaatgaaataatggcatttgcagcaacctagatggagttggagaccatttttctaagggaagtaactcatgaatggaaaaccaaatattgtatgttctaacttctaagtgggagctaagctataaggatgcagaggcataagaatgatataatggactttggggacttgggaggaatgggagtaagggataaagtactacatacattcggtgcattgtacattgcttgggtgacaggtgcaccaaaatctcagaaatcaccactaaagaattatccatgtaaccaaaaccacctgttccccaaaatctattgaaataaaatttaaaaataataaggaggtttttaaaaatgaaattcactatgttaaaaggaattaaaggatgtggacaatgttatcaaatatagaacctaggaataaaagatgaataatacttttgcattaagagggaactaaatgagctaccactagactgtggggagttaatgggagtatattcattctaatatttcttggttgtctcaagacaaatctcttcctagcttagctctctattttggatatatatttgcaaagcaaaatcctatatgtgtccaaataatgtatttgaaccaacataaacaatggttcaaatacattattcccattttactttaattcttgatgaaggtccagatgctatgattgcactctatgttgagccttataaattgtataagaaatatgggaaatggaaatgtatttattttaccagtccccaactttaccatatggagcatagttgctaaaatcataattcttgggaattataaaacctactattaaattttacatttatttcttgcatttataaatatataggatttttgatactgtgaaagttttttctttaaaattagtatattattcaaacagcatttattattttctttcataatcatcaaaagctacaactaaaaatttaaagcatttgtcaaatgatgctagggaaattcctcaatgataaaatctaggagaaagtaatttctttggatttcaattacagcagttttataaggtaagttcagaaagtgaactaaatatggattactctgaaagatgtgttactaaatatttttcaagatttttagatttttctttttctgttcttttcttttttttttaacaacaggaggattatactgactgtggtggtgtttctggattaaatccctccctgtggtatatcattggaatccagtttctactactttggctggtatctggcagcacacaccgcctgttatgaccttctaaaaaccaaatctgcatagttaaactccagaccctgccaaaacatgagccctgccctcaattacagtaacgtagggtcagctataaaatcagacaaacattagctgggcctgttccatggcataacactaaggcgcagactcctaaggcacccactggctgcatgtcagggtgtcagatccttaaacgtgtgtgaatgctgcatcatctatgtgtaacatcaaagcaaaatcctatacgtgtcctctattggaaaatttgggagtttgttgttgcattgttggtgattacatgtgaaagggttccccatacaattgttaatgaaccataagaaatgtcttgatattgacctggaattttgacttgctgcaattttactaagaaaatctctaaggggaaagaaattatttttgccttcactttttcttctgtgaaaagttaattcctgctttaagtagcaattattgaaatatatagagaaagagagaattaacattggtctaaattgttgaaatataaataatggctaattttctatgaaaaatttgccatgaataaaatgccttatgaagaacggcttctttgccaaaaataaaacacaattgatgaccaattcaattttgatggggtaatgaattgatggtttgaaaatagtaactaagaaattattaaactaaaggtgcttgagggagaaattagaatatgtgacatatttcctcataaatgtaagcaagcccttaataaatgctttgatgtaatgttccttttgttcacagtacagttatgtagtgctagccagatatttaaaaatgctctaagaaaagcttgtcaggggggagggggaaatgtttttcttgtgataaatgaactttggtttaccaagggtattttgcatgatgctgctgctattttaacttttcagttgttttttctcttactgtagagtgtagtcattgaaaagttaactgagtgatattgttatgtaagaatctgaaccttgcagtgtaaatgcacttaagtcatctttaaaatgttgttaaactactctgaatatactgtgcaatgtaaatgctgaatgattggggttagataaatggtgaaatgagaattaatgaattttatacagattcatgctttcgcctgataacctatgtacagatattttaagtacataaatcagatttgacacatttattttttgaaaagtacatatatgttctcaatgaagattcatcctaggtttcctctttgttcgtttcaatagtagcacatacaatccaaaagttcctgctactgctgcttttgcccttccattttaaatggtatgatcgtttggccaaaatttccatgcaagttgataagggttttacaataatctgaacaaataggaaaccttgaatctctatgtatgcacatgaatacttgattgtgaataataaaagttgttttttatacagcctcattggtgaaaatggttagtgtagtaaatcagatatttcattatagactaatatggtagcagattatttatgcttttaaaaattattttctggagcaaacagtatttgaagaaaaggtaaaaactatgaatgtgtaattctaagaatagttaataattttactgaaggctgaacgtatgtagatattttttatgataaaatgcagtttttctttttttggaacatgccaattactggtatgtgtatatgctggaaattttcttacatatcctttttaagtcaaagttattaacattatccagcatgctttaatatgctccacatatcaaagatataaccaataatttaacgtagcttaaaagataacatttgttttgtttttagctttgcatacatttgtaattccctcccaccaccaatataccttaggtaccatttgtgtacatttcaagattttttttttcaataaaaaggtggggggaaatggaatcactttgccaactattgttctaagagttgacatcagttaccatttctaatgcattgttgtgattttgtagtgtcattcataactggtattgacattttagaaaacaccaaagtgatttaaaatatatgtggggaaaaaaacttctcactctagtaacaatgttttaatcatgttgtttgttaaatatttaaaagttattgttcaatttttgctagactatcttaaatcatgatagtgttgggaagggggtatcaaaatataaaattgttagtttgtgtatataaacaatgcacattaaaacaattgaattgcttccagcatacaacaaactaccttaaaattatgttcaaaatctattaaatatattttcatggctaatgtcgagtatatgttttcatcaattacattgttattgtattaatcgcggttaaacttggcatctcttggcaggatcctatttaatttctgttgccatcaaaatatatttatatgcatgagttttgctataaacctttattttctgctataaagttatatattatgacaaccataaatgcaattacaaattgggtaagaacaagctgaataaaagttgttcccatgactaatattagtcttcatgcttttagcatattttttaagacagtaacactcatcccatcaaattattacattacatttagtatttttctgagttacattgacaagaacttaaattatagcctgttattaatattgatttccaacgactgaacagtacaacagatcaataaaaaagtttatacactgctttaactaatttttgttatactcatgtggcttagtgtagttagtcactaaaacagagttcaagtgagcttggcaatggtgttgagtaacaagaaagaattttgcattaatgatttctttttattttcctcatttaaacaaccagcattactgccaaacaccaaccgtggtccatatttgtaacaggtttttaacatgacatagttagcaagtttgattgaagagatttttaggtcctgggcctataagattttagtatgatcttttttcatgtttctaatgcttgaggtgttactgcttaacttgggaaaaaaaaaaacaaaaaacagtgttcctgccatttgtaagttttcctataatattccttttattaactttaaaactggacttatcgggttcaaataggcagtatcccttttaagtgacctttgcaacccaagtgttacttgcttatttgatgctctcttgtattttaaatctcatttaaatctttgtctgtgaccaacaaagcttaagattttgtcttcatttaaaactctgaatctattccattgatcatgttagacgttcaaatgtttaatggtatagtctgacctagtgaaacaaaatggatgttgttactttttttaaagaatagaatgaaataactatttcacttgcccaaaattttaaatattttttcatctaaacttgtattgtttcccatagcagaatgtcaatattcacagtacatttctgtaaagagcaaaccaatataatgttttgagtgttgaaaaaaattccagatttttgaagaattagacaactcttcatctaccttatttctagttcacacagttatctcaaattccactgaaactaatgggatactgtcttgtgtagatgccagttgagtttataatgtgacctagtaaagctgtcttttttgttgtgttgtatgagtgtcggatcatgcttttaggaatacttttattaaaatggtgtgcattcatgcaaaaggccaactggcttttgtgaacaatagatcttttctcccctttattttgttctcttgacacttttgtgaaaattacctagcctgataaaaacattttgtaaaaatttgtataatactgttataaaatatttataatcccagaaaatgttgtgttaaatcttgtgcaaaaacagtatattcagaataaaagtttatcatttaaagtcaccacgcggtttgggttttctgctttttaaaagatccagttggaagagacagatggctctgtcataaataattttaagagagaattctggattgtggaaataaaagttgggattaaatagtgcttttacaattacaaacctcaactcacacaaatacagtcaatccttgaacaacatatgtttgaaccacatggatatacttatatgtggatttttttcaaccaaatgcagattgaaaatacagtatttgcaagatggaaaacccacatataccaggtgcctactttctgtatactcagattctgcggggccactttccagacttgacttgggtatgcattgattttgatacacgtgggcatcctgaaactgatcccccccacgcacagagggatgactgtcaattcactcgcgatgcctttacttaagtctaaccttctaacatgccttctccatcaaggcacttaggaatgtacttcatcagactttggacttcttttataaaaaaaagttccctaatgtttccatgtttctttaaagacctcagaaaagtaggttaaaagaaagaaacaagttagagtatctgaaatgtgcttttcttctatgcatctaacatttgaacagcagctgaggcaatgaagtataaagaattttccctaaaagccctattagattccttttacacttataccagcttacaacctgacttcctatgctcacgtgataaactgatgagcctgatgttatatggaatctagtataacgtaggcctaccatctttttttcctctggagaatttgaaaaatacctacgtatgggtggaatgtagtatgtgggtacccgtgatggtgattactggaaaatctgacccctatgtctgataaagacattttaacaggaaaggaaaaaaaaaaaaaaaaactacacgaaagtgtaacgtagattacatttgttttttgaacatctggattcattctataccaatttatctcttcaattttctttccccagagaccttcatttcctctatcaatcattttgatcccactcctgcctcttctcttgggaccttgcttcatcagttcttctttctcaagcatattccgtaccccttctcagcaggcttctttccctctggtctaaagtcatttggaacacctctatctaaaacaaactgaacaatcaaacatccacccctgcctattaaccctattacttcctagatttataaacctagaattatttatttgtacatccacagacatatattggtagtcttttctccttggcgttatattcaagtaggtcttcttagaattttagatctttaagacacattacctctgaccaccagatttcactactgctgaaaatttttaattattggtatgaggtcctaataaattcaagttcttggatatttctcaattcctaaatgtttttgtatctcaaagtggagttatccaccagagcacctatatactttcctataaattgctatacaactcaaaaatgctgttttatatttaataagtggactgtttaaaaatgtatgagaagaaaatttaatatcactaccataatttgaaaatgaatataacttgcccaatttagtaagtatgtcacattaaagtaggttcatagctattgcgataagaagagatgaacaaactcactcagcatatgccagttgtcaaatgtgccacatttaataaaatgcttcatcaatgcatttattatgaaagtttaggaagtttttgcataaaatgtaaacatggacccaaatatcagactgtatactttagttattaatatgttaaaaatgtatactcatgaaattttgtcaaagtttggcttttcttagatgtgtagaattttcccccaaatgatttattatctaatagttttgggtcatttgaaacattttcttttttttttatctaaaaaataagttcatcatgaatcttatatgggaagggtgaatgatttaaaacatttcttatactgtagtatgaagtttccatgaaaaaaaatgctcaagatttaaaaaaaaatagctaatgcattataagacagagagcttatgcaattctaagtgctttcttttcacatgaagcagcccagaggagttaagtcctgtccaaggccaccagctccttttgccaaaactggactaggaactcaagttggctgactgttagtaacttccctagagacagtgattccagctctccaacatattgatataaggacaatgtatgtataggtcggagtaaaatgcaggcaaggttgccaattttctgtattaggaggaattcccttttccagatattcttatttcccctgtttgaggaaaaatgacgttttgtgaaagtatggcatcactgattattgtaaacagcaaattaaagagttagcaaacttatgttacttgtcattacttcagttagcaaacttacgttagttgtcattacttctgttaccctcccttcttttttattttataattatagtgacctgtaaaatttctcaatccaggaactatagtactaccctggtccacattgtgagtgcagtgtagccacgtggtcactggaattccttgcttcaatttaaaacctgacttcaccacttactagctatggaatcacggacaagttacataatatctgaaagcctcagtttcctcatttctaaaataaaaataacagtaacaacattgaaggattgccatgatgattaagtgataaaattaatgtaaataatctagcatagagcccagcattgtgttaaccctcatcaatgccatacattattatgaattgttatcatgacaatcatcttcctaatacagtcttcattttgggctgaagcgctaaagatcctaattatctacatgtatccatctgttttgtgttgtataagggaatacctgagtctgggtcatttacaaagaaaagatgtttattttggctcatggttctgcatactgtacaacaagcatagcaccagcatctgcatctgctcaatcatggcagaaggcaaagggggagcaggcatgtcacatggcaagagaaagagagatgctaggctcttttaaacaaccagctctcgcatgaactaacagagcaaaaattcactcattaccgtgaggagggtaccaaaccattcgtgaaggatcagctcccatgactcaactcccagcaggcctgacctccaacaccggggactacaaatcaacatgacatttggagaggacagatctccaaactatatcactataccattagtgtgtaatttaaatttttttttatttttaaacttttaggttcaggggtatatgcgcaggtttgttatataggtaagttgcatgtcccggggtttgttttacagattatttcattacccaggtaataagcatagtacccgataagtagtttttcaatcgttttcctcctcttaccctctagcatcaagtagagcccactgtctgttgttctctcctttgtgtctatgtgtactccatgaaacatgcatttattctttattcaactgaagtgttagatgtggaccctttatgcaagataaaaatagttcctttccttgagggactactggctgagaatattgaaaatataataaatatttacaatagtgagatgagtgctattgtgtaggaaataaatgttattataggagcttacagaaaagtaacctagcaagactaggctggccagagaaggctgtcatggtcttaagctgaaggaaggagggggcaatactgtaagaaatggagaagagttgtgtgaaaagagatgcacccagggaactagaagtagctgaatgtgacagttcagtctggctgaagggatgggcaactgaagatgaagtggaagatgccgctggagagatgaagaaccagggcctgaaactctctctgaatcacatttgggtatttaggtaactgaaagccactgaagagttttaggcagagaacagtatgatcatatttgcgttttaggacaaccgctctgggtgaaatacgtgttattgatagaagaacaccacagataaggagaccacttaggagcctaccatcaaggtgtgaaacttttgttaactggtaggaaggtagatagagaaaagtggactgatctttgaaatatttagaagaaaaaaaggagaagactttatgattcactggttatattgaaaaaaaaaggggggaaacagaattactctcaggattctgaagtttagcatcctggctagcagtgcagtcccccaagttcgggggagaaaggaggatgcccaaggcattggtgaggtagacggggcaaatccagaggagaaaattaaaaattgcacttcagaaatattgtgaatgagcctttgtacagtgttcaggatatgaagacaagaaaatgcaaagatgggtgggtcgctgctgcccaagaatatatacactcagtgtgattcttaacactgacagcatgttagaaatgcttattgggagttttgttggtttgttttgttttatatattgatacttaggtcccactctaattaattcagaatctcgagtgtttcctgcagccagggttacactagccaggaggatgttaagtgacaggagtgacgattcagaggcaggatggttctgaattgtactttataagtatcttcataaaattttttgtttcaattttaaatgaacacattgagtatattttaaaacacattctataatcccattttgattgcattatttttgaagccttttctattcatttttctctttggatccggattctatagttggacatacctgataatcagtaaaattctcattgattgtggttgatatttaggaccactattaggataattctttttactagacattctattcctatttaagtcacattaataacatcaaatgtcttatatagttgcaccacagatttctataaatattatcaaacaaaaagaactttgtcaatcagattctttcttatggtaaatgaaatacagacatttatgtatccaaacaacagaataaaattagaaaattacatgacttgacaatatgtttttttacatatcacttttaattaaataatggctatttcttgacacaataaaaagctaatcaaaacttaaaatcccacttaaaagatgactatttcggattgattgcaggctgcctgctcatcttaatttacaggccctcaaaaaaatctgactgaggcaaaagagactgtggtacatgatagaagttcctgtctctacagattgcctggggacatatcccagctccccaacttgggcatgttgtatgacacctcaaagtttctgttcttgcctgatttattttattcactcaataaatatatatgtataataacaatgattatagtcactacctaatagtcactcaggcctctttcttaactgagaaacttaatcattctgatgctgatgattttaggaatgcctagagaaacacgatctgaagaagatttctaaggtataacaaatattaccaagatctcaaaattttctctcttctgggcactggaaatataatgatgagaaacacaaacacagtgcaagttgcaggagaccattgggagagtattcatccaaaaattgcacgaagaggcatatattactaactctaaaaaagcactatgcaataaaaagatcttggtaacaaggagttgatagcagatggaaggaaagaacctgacaggaagtgacctgggtttagcgactgagctgggaagaaggtggatggacgattcacactgccctgggtgtcttcatccaaatctcagcaacaatttgacatctggagcacagtatatacagactaagtagtggagaagcagatggcaatgttagctctgggagaatgtttgacttcagttaacagctgagggtatgaatgaagaaatttcttctcacttatgggccaatacttaagtttccctcaacaaaaatgcattacctcaaccattttcttatttcctttcatcaaaaacctttaattttctctgctaaatttctacttgtcctccttttcattagtcctcagtctcctgaaatttcatctcaacctctcctccaaaactgctttggatgatttcttaattgctcattctaatctcaatatattctgtcagtttccctctgaaaactcagacttctctaagtcccagagcttcactgccttctcactcactctcttctcaagatagtccgactcatctgccccttaaatattggtgtttataaattctttacctatatgattttattaaatgttatggtttcctatcttcattctggtccaaattcccaatcgtcattggatactcatacctaggagtcttaaatatatgactaatctaacatacctagaaaataactaacatctttctcaatatctcttcctccttttgccctctgtatctcaggacatagtcaaagcggcaaagtcagctaagctagaaactttagtgtcattaaatgaccaaattctgacaagcctacaccttaaataccttttgatttcccactactttctacacccactgctactttctttcttcagacttttgtcaactcctgcccaaccatttacatgattcccaactggtttccctacttcgggtttctttccacttcaacccacccccatcgtacttattttctaaaatttacctctgatcacatcttccccctttaaaaaatattcagtgactccccattgcctataaaataaaatataagtgccttagtaggacatatgacaccaattagaagcaggcctctcgctacttatgacttcatattcccctcattcctatcccaacaccaaaaaaaaaaaaaaaaaatgccattttaaattaaaccttaccaaattacctaaagtttttcaaatataacacactaattcattttcttttgcggctgaacacaactcccacaatgccttctcctaaactcccttctactgttaccaatattttaatacccactgtaaatgctaccactcctctagagcattctctggtgttctgagtgcttgggccattttctcctctgtttttcaacatagatttgagtttgaatgtttgccagaatcatcttaaatatcatttatattaaattacttccttttaggaaacaaacagggagagcttggaaataaagaaaacccaagtatttactagacactccgctctgggccaagtgagatatttggaacatatctctgttacaatctatgaaaatgtggcatacttaaaaaaaaggtgtgaactttagaatgttaaaaaacctagtgtcaactgtagctttaatttttactagtgtgagcttaggggatcagaatctgcaattgtaaattgtcacagcattttctttgcaatatggtgggaacaattactaatgatataggacaggcataaaataggagcttaataaataataccaacttgtagtaaaataagaacctaatctcctaataaccatactgtctctggaattgccagaataacaagaatgcttcaagtagtcaaacatttggttaatttttcaattaaatttccatctcaatttaaataatggttaagctgtgacatcttccggagggcttcttctacttttccttctaatagaacatcattccacttagtacaaccccatgtcaggttaggaaaacctaataagacatgtcaacctgcatctcagactgtctcctctgtaactcaagaatctatccctaaattgtttttttgaatcagaattctgggattagtaaaagtgggacaggacaaagagaaaatggcagatcaggtagatcatttttaaataagaaaggtataatgatttaaaaaataaacctgggatgcaaaatcagaattcaagagaaagttttaattaaaactgagccgttaagtttactgatggacttcctatattctcctaaattctagagtcagcagagcctcaagaaagacattaagtgtctcacaactgatggtaagcaagtaaaagtagtcactagataaagaaaggaaagtaagtggaaaggatcaacacatttcgatttttaaaaaaaattaggatgagcaatacagacagggcaagaaagtctcaagtccagttgtttctatttctttttttctggagacggagtctcgctccgtcgcccgggccggagtgcagtggcgccatctcggctcactgcaagctccgcctcccaggttcacgccattctcctgcctcagccccctgagtagctgggactacaggtgcccgccaccacgcccggctaattatttttgtatttttagtagagacgggatttcactgtgttagccaggatggtctcgatctgctgacctcgtgattcgccagcctcggcctcccaaagtgctgggattacaggcctgagccaccgctcctggcccagttgtttctatttcaactgtgactaatacaacatggactgtaactaggcaaaattacggtggaaaatgtttctttaaagcttgaatcctttactgccttgatacctcaacctttttttctgtggtgaaaaatcattgcactcaaatggcattaaattgaagaaaagagcaaaattgtaaagcaatctcagccaatttatattataaattacatattagataccatatgtaaggaagtataataccaaaagacctaaactatagccctaaattattattaactatataattcagtaaaagatttctgcatacactattattctgtttcataaatagaagtaagaaatgctgtgaaacaagaatggagaatcaagaaattcatgaataaaaaagcctgagagaatggttaagctaaatctgaaaacatagcttcaagctgatcccaaaaaacctaaaattgtgctttcaaaccatagtgtgtgttcctgaacacccaagtacatgtcttattaatccctatataattagtgatgtcacagggccactccatcccaggggataccatttagggtgtgatgtggcctcataagctagattgctgctgatttgagccagtctgagtcactccctctaatccaaaggaaagactataatcctaacatgtctcaaacccttctgtatttgtctcttgggatagtgagagcttgaagtcttactgaaccactcattatgaatcaggagcattttgatcagtgctattgtcttgcctgagttttgtaacaatgaagtatttatacccctgtgcttacacaagtgaatactcaggggcaacctcctccttaatctctccttgtattgttattgattgcaaaggaggagtagggtgagcctggagaaaattccatcaaccctctgaaccctattctattctcacctaccaagggttattcctagggtttcaaagttctcagtgactcaagttgtcatttattttggtatttctctttcaggctattcctaaatatgcattatgaaagtttagtagtgtgcccttcatgtagtaggattgatatgtatataaaaataaaatattaagtagtcttcactaatgctttgaacttcctattttcctaaagagaaatacaaaatattactgagattaacttaagtatctcacaaataacaacataatttcttccagtgatttccttagtagtatataaatctttgttattatccttatagggaattagcttctcaatatcattttatcccttaggcatagggagtttgttacatatgatcatggttgcctagggttgccataaatcaccaccaagtggtagtttacaaacaacagaagtatattatctcacaattttggaggtcagaaattcaaaatcaaggtgttagcaggatcacactccctctgagcctctaagagagaatttatttttttcttgtctattccagtgcctgttactccaggcattcctcagtttgtagcagttaattctaattttggcctctgccttcacatggccttttccatttgtctgtgttttttcctcctgtgtcttttataagggcatgtatcattgattttaggttctaacctaaatctaggctaatctcatctctagatccttaacttaattacatttgtaaagtccctttatccaaataaggtcacattcacaagtttcaaggattaggacttggacatttcttttttggggacacaattcaacccaccatacatattcccttggcattatggtatttgagtggaaaatgcttattatgagttccctaatttatatctccaaccttgttttttcccttatgtccagattcttacatccaagttgatatagtagatggccaatttgatttctccacctgagtgtgcctcaaaactggggtactcattctcccatcttccaggggagtcgactagttgtggctcatagctaagattctccccagaaattactttggggtggaggaagctgcttttctccaagtaatacccacttcagagggacaaagggacagaaggacaggtttggtaacatgtctcaattcagcccatctctggagggccatcccagctccagtttcccatgagattgactgacgcctctgtttcagctgtacatcaccaatttctttgtcaatcctgctttcttccttcacaggtactgttcctgagagttctttgcaaaaaaccacctatatgcaagtgtccatttcagtttgttcccgctagaatgcagcctagaaaaaaaaaggcatccctaatctaacatgtccctacataactcttattgcaatgtatcttccaccacttcacattctgtcccttccattaaaagagttccttccccattccccaactttgtaaatgacaccaacatccacagaattttcaagccaaaagcataggaattattgtacttcgtacccttttcttttaccaagatcctatttagagccaagtaattttacttctaaattatattggatatctgtctagttttctacatttccattaacactcccctagtgtgatcatcatctcctcccatactactctcagttattagaactgtgagcctgggcaatttacttactctttccaagccaccatgaagtcgaaagaataatagtactaatataataacagtactcaacattacagagttgctttgattaagtggttaataaacgtagaagggctaaaataatacttggcatatagtaagtgctatcgtgtcagttattataaatattccgaaatttaattaggtcgcctcttgtagtgggaaagggaaaggaatacaactgagtgaggagaattatctgtggacctctccagaggttggctttgtacctagtgttaaatcatgtacatctcatggcatgtaattgcaccatattattccatatggtggaatcccagaacccaagttagtttaaagtaaacattcaatgtgcacatataataatgaagtaaatgttatacaaaatattttctaaatactacagtatttaaattttatctaagtggctctaattcaagaacaagcagttcagatgctcccagaagtacaggctatcagtgcattccaggagcacgttgtgggttgattatttccagtacaacatcgtcctactgccatgaatttgcttgctggttaatgtctataaaaattcccacagatgtgtaaaaatatgtatttgactctgtttcttcttatccatcccttcccacactttgtggtaactaaataggaaaatcatttcttgaatatctctgtactatggttaaaatgtagtgatccaaagataaaagcttatatatgtgatccagtgccaaacaagtccctagataaaataggtattcaaagcatgaattaggttactgtatagtattttacttgacagtgaagtttaacaaggatcataagatatgaatacataaattttaaatccattatcatggataaggagatcattttattaagtcagtctattacttgtaacaacaatagtataatgagatatgagaatttaagattatagttttttttaaaatatagccattggaaagcacgtgttgaagtttaataaaactgagccatggctgatttattaaaaacttatacttaaattgttcctatttttttcttttaatgttttactttatttatatatttatttatttatttatttatttactgagatgggtgtcttgttctgttgcccaggctggaatgcagtgacgtaatcacagccttgacttcctggggctcaagtgatccccctgccccagcctcccgatcagctgggaccacagacattcaccactacactcagttaatttttttttcttataaagacagtgtctcactatgttgcccagactagtctcaaactcctgggctcaagctgtcctcttcctcggcctcccagaatcctgggactccaggcatgagacaccactcctggctgaaattcttcctatattttattcttattgtttattattgtttatatatccattcagcaagcttttaatatttacattatacacacacacacacaaatagaaattgttgagtgctaaaaaaattaataaaatttggtcccttctctaaatctagttgaaagaactagattaaggttggaacatttatttgtctgagcaagaaggcggctcccaattcccctcatgcccctttttgccattgggttgcaaaaaagtataaacaccatggaaatgacaatgttcacaaaatatttcacaaaaatgcacagaacttccacttcaggaactttctattagtatttagctcttgtataagttatagtagaacctctaacgtttaaaaaaaaaagtaccctctgaaattaaaaacacaaaatgcttgaatagcctcttttgatactggagactaaagttttagacacgctgttccaaaatatttatattaataactgtcagatttgaatggtaccctcaacatgacaaagttccatgtagtccaggatacaattgaaactgtgtttgcaaaatcatgacagttaagagaaatttgactccatcttgcctctaaccaccaagctgtctttggtcattcctgggcataggccaagctacctttgggagaaatttagtttatagtttaaccttaaagcaagatggtaatagcccttccctaaactaaactgcctttataaaactggtgaaagctataaggttagggttatgaggaacctgaagtctgctaagatgtaggcatagtttctgtaatcccttactgctgaggagtcaaatggccagagatcacaggatttgtgacttccctaattgctcctatacatcacatcactatcgtagaacctaagattggtcttttgagtttttttttttcagatttttgcatttctgacaaccagctgacttcactcagacctatgacccaaccagtcctgtggcccctgccgagtggctgactcagtgcacgaggaccattttctataccctatgatttcatttccaaccaatcaacattctccattccctagccccctgcccatcaaactacccttgaaaaaccctcacctctgatctttcagagagactgatttgggtaataacttcgtctcttgtatggtcagccttgcatcaattaaagcctttctttactgaaataccattgtctcagtgagctaattttgtctgtgcagtgggcagaaagagcctattgggcaattacacaatcagtgcaagtacctccgctactcaacctcacaaacctatgtattaattggagctcaaaatgtttgcatctaatagactctttgtagagattattttcccaagtaggagaacaatacggtatttaagtgaggcacttaactttcagctaaaaaattatttcttattgaaggggattgggagacaactaagaaagaaacagacaacatagatttcaaaacaaagcctatggaggaaatgaaatgtataatcttgcaagtcaaatgtgtgtctgggacacaaattgattatgtgtccaaaattatccatctctcatagcttactaaggggtcaactgtgcctgatagcattccacagttaaggtggaattgtggtatgtggactagacctgagaacaccctgaaggcacaaatcagttgcatgagctgggtgctccgactttagcgttcctactcatggccctctctagttatcctaattagggcttcatggattgcttttatgaccagttcaaagaggacaaataacaacaaccactatagatagctctgtgtaattcattagcattacttacagaagatttctacagtattaagtcccactgaagattggctgtgaaataaaatgaataaaataaataccctttgtaagtgggacaattagcactatgctttatcttccttgttacctggaagtcatggcctgagatcaggttgtacattggctagtagttactggtttctttggccaggtgatcagggcctaaggctaatactgaaagactgataacatgaagaatttggaaacactcatgtgtggttggagctctcagaatgtggttaaagtctctaacatttgttccttaggagagaccaccagaaatccccgccagaaaacaattcttaagaactgtagtgtaaggcttaaaattaattccaaatattatatgccactttgacatctgaaactgggacagccatgcatggcctgaacacaggttcttttttctgctctgctcttggaatctggtcacctccatatccaatgaaccaggcaccattcttgcttatctcacagtaatgggtttcacttccttgccagcccagtagaattgttcgaaaaagccaaatacatcctccctccaaaactagaaggaactgcacgctcttgatactgtactacaaagcttcccacaaaccctatttgttcactttgtcattgaatgcaaccccatgtggacctgaatgatgtccagagtccttcttccccaaactgtgagtataatttgctgtcaatctcatctctccactgttaggtattgtatgttcagcaatttccatattcctagggcagaaatcctagggatgaataggagtcatccctcaccaatggggtgagtagagacaattgaaagtataacctattagatagcacaatgaattattcagattttagtcagacttgccattccttgaagccaaagaatcctaactgaaacaacttgatctagaaattaaccatgattccagatacgtgatggagccattgctgagtaagggaagttaagagagggactacattcaggaggagaaataatgagtttatttggcaagattgggttttagaagtctataaggataaaaaggtatagagcagctgtgggatataaaagtctgtatctcagcaagaaaattcagaggaaacaatatagattttggcatcaatatataaacaccacttgaagtcatacccttagatgtagtaggtcaggaaagtgaaaagttggcaacaaatttatctttagtctaatgaatctttggacccttcaaccttcttttatgccaatcttatttattcaaatttcatacgcatacagctttttaaaggacataacagatgtcttttaaaaaggtattaatttgcatgtgtatgcataaataattgcttgcttcttaggtaagttctataactaaactgcgtctaaggtcttagatcactgacttagttcaggctgcaataataaattatcagactgggtggcttataaacagcagaaatatatttgttgtagttctgaaagttggaaaactgagatgaagttaccaacacagttggcttctggtgaggagcctcttctgggatggagactactaccgacttgtatctccacatggtggagggcaggaggaggaagtaggttctctctagtcactgatatgggcactaatctcattcatgagggctccactattataagctcatctaagcctaattacttcccaaaggccctacctcctaataccgtcaccgtagggggttggtggaggctggggttttaacatatgaattttgggggaacacaaacattcagcctataatagccatgcttaaaatgaatcctaagcactaagtaggaattttctcaaatttcttatgaaagaattaaatgtatcatacatttagtttagatggatgaattggcaaaacaagaaaagtagaatatggaaagggtagtgaggtgggtaaggaacagagggaatattcattttaaatattctcctacatgaactttt
